US012565641B2

(12) United States Patent
Ching et al.

(10) Patent No.: US 12,565,641 B2
(45) Date of Patent: Mar. 3, 2026

(54) ENGINEERED TERMINAL DEOXYNUCLEOTIDYL TRANSFERASE VARIANTS

(71) Applicant: Codexis, Inc., Redwood City, CA (US)

(72) Inventors: Charlene Ching, San Jose, CA (US); Stephanie Marie Forget, Redwood City, CA (US); Anders Matthew Knight, Mountain View, CA (US); Mikayla Jianghongxia Krawczyk, Palo Alto, CA (US); Niusha Mahmoodi, San Francisco, CA (US); Melissa Ann Mayo, Foster City, CA (US); Mathew G. Miller, San Carlos, CA (US); Jonathan Vroom, South San Francisco, CA (US)

(73) Assignee: Codexis, Inc., Redwood City, CA (US)

( * ) Notice: Subject to any disclaimer, the term of this patent is extended or adjusted under 35 U.S.C. 154(b) by 34 days.

(21) Appl. No.: 18/046,451

(22) Filed: Oct. 13, 2022

(65) Prior Publication Data

US 2023/0183663 A1 Jun. 15, 2023

Related U.S. Application Data

(60) Provisional application No. 63/329,777, filed on Apr. 11, 2022, provisional application No. 63/256,353, filed on Oct. 15, 2021.

(51) Int. Cl.
*C12N 9/12* (2006.01)
*C12N 15/63* (2006.01)

(52) U.S. Cl.
CPC ........... *C12N 9/1264* (2013.01); *C12N 15/63* (2013.01); *C12Y 207/07031* (2013.01)

(58) Field of Classification Search
None
See application file for complete search history.

(56) References Cited

U.S. PATENT DOCUMENTS

| | | | |
|---|---|---|---|
| 5,605,793 | A | 2/1997 | Stemmer |
| 5,763,594 | A | 6/1998 | Hiat et al. |
| 5,811,238 | A | 9/1998 | Stemmer et al. |

(Continued)

FOREIGN PATENT DOCUMENTS

| | | | |
|---|---|---|---|
| CN | 112746063 | A | 5/2021 |
| EP | 0641862 | B1 | 3/1995 |

(Continued)

OTHER PUBLICATIONS

R; Yang, B.; Gathy, K.N.; Coleman, M.S. Nucleic Acids Res. 23, 2041-2048, 1995.*

(Continued)

*Primary Examiner* — Richard G Hutson
(74) *Attorney, Agent, or Firm* — FisherBroyles, LLP; Adam K. Whiting; Adelaide K. Leitzel

(57) ABSTRACT

The present invention provides engineered terminal deoxynucleotidyl transferase (TdT) polypeptides useful in template-independent polynucleotide synthesis using a nucleoside triphosphate-3'-O-removable blocking group (NTP-3'-O-RBG), as well as compositions, methods of utilizing these engineered polypeptides, and polynucleotides encoding the engineered terminal deoxynucleotidyl transferases.

42 Claims, 7 Drawing Sheets

Specification includes a Sequence Listing.

(56) References Cited

U.S. PATENT DOCUMENTS

| | | | |
|---|---|---|---|
| 5,830,721 | A | 11/1998 | Stemmer et al. |
| 5,834,252 | A | 11/1998 | Stemmer et al. |
| 5,837,458 | A | 11/1998 | Minshull et al. |
| 5,928,905 | A | 7/1999 | Stemmer et al. |
| 6,096,548 | A | 8/2000 | Stemmer |
| 6,117,679 | A | 9/2000 | Stemmer |
| 6,132,970 | A | 10/2000 | Stemmer |
| 6,165,793 | A | 12/2000 | Stemmer |
| 6,180,406 | B1 | 1/2001 | Stemmer |
| 6,251,674 | B1 | 6/2001 | Tobin et al. |
| 6,265,201 | B1 | 7/2001 | Wackett et al. |
| 6,277,638 | B1 | 8/2001 | Stemmer |
| 6,287,861 | B1 | 9/2001 | Stemmer et al. |
| 6,287,862 | B1 | 9/2001 | delCardayre et al. |
| 6,291,242 | B1 | 9/2001 | Stemmer |
| 6,297,053 | B1 | 10/2001 | Stemmer |
| 6,303,344 | B1 | 10/2001 | Patten et al. |
| 6,309,883 | B1 | 10/2001 | Minshull et al. |
| 6,319,713 | B1 | 11/2001 | Patten et al. |
| 6,319,714 | B1 | 11/2001 | Crameri et al. |
| 6,323,030 | B1 | 11/2001 | Stemmer |
| 6,326,204 | B1 | 12/2001 | delCardayre et al. |
| 6,335,160 | B1 | 1/2002 | Patten et al. |
| 6,335,198 | B1 | 1/2002 | delCardayre et al. |
| 6,337,186 | B1 | 1/2002 | Krebber |
| 6,344,356 | B1 | 2/2002 | Stemmer |
| 6,352,859 | B1 | 3/2002 | delCardayre et al. |
| 6,355,484 | B1 | 3/2002 | Patten et al. |
| 6,358,740 | B1 | 3/2002 | Patten et al. |
| 6,358,742 | B1 | 3/2002 | Stemmer |
| 6,365,377 | B1 | 4/2002 | Patten et al. |
| 6,365,408 | B1 | 4/2002 | Stemmer |
| 6,368,861 | B1 | 4/2002 | Crameri et al. |
| 6,372,497 | B1 | 4/2002 | Stemmer |
| 6,376,246 | B1 | 4/2002 | Crameri et al. |
| 6,379,964 | B1 | 4/2002 | delCardayre et al. |
| 6,387,702 | B1 | 5/2002 | Stemmer |
| 6,391,552 | B2 | 5/2002 | Stemmer |
| 6,391,640 | B1 | 5/2002 | Minshull et al. |
| 6,395,547 | B1 | 5/2002 | Stemmer |
| 6,406,855 | B1 | 6/2002 | Patten et al. |
| 6,406,910 | B1 | 6/2002 | Patten et al. |
| 6,413,745 | B1 | 7/2002 | Patten et al. |
| 6,413,774 | B1 | 7/2002 | Stemmer |
| 6,420,175 | B1 | 7/2002 | Stemmer |
| 6,423,542 | B1 | 7/2002 | Crameri et al. |
| 6,426,224 | B1 | 7/2002 | Crameri et al. |
| 6,436,675 | B1 | 8/2002 | Welch et al. |
| 6,444,468 | B1 | 9/2002 | Stemmer et al. |
| 6,455,253 | B1 | 9/2002 | Patten et al. |
| 6,479,652 | B1 | 11/2002 | Crameri et al. |
| 6,482,647 | B1 | 11/2002 | Stemmer |
| 6,483,011 | B1 | 11/2002 | Stemmer et al. |
| 6,484,105 | B2 | 11/2002 | Zhang |
| 6,489,146 | B2 | 12/2002 | Stemmer et al. |
| 6,500,617 | B1 | 12/2002 | Stemmer et al. |
| 6,500,639 | B2 | 12/2002 | Subramanian |
| 6,506,602 | B1 | 1/2003 | Stemmer |
| 6,506,603 | B1 | 1/2003 | Stemmer |
| 6,518,065 | B1 | 2/2003 | Stemmer |
| 6,519,065 | B1 | 2/2003 | Colbourne et al. |
| 6,521,453 | B1 | 2/2003 | Crameri et al. |
| 6,528,311 | B1 | 3/2003 | delCardayre et al. |
| 6,537,746 | B2 | 3/2003 | Arnold et al. |
| 6,573,098 | B1 | 6/2003 | Stemmer |
| 6,576,467 | B1 | 6/2003 | Stemmer |
| 6,579,678 | B1 | 6/2003 | Patten et al. |
| 6,586,182 | B1 | 7/2003 | Patten et al. |
| 6,602,986 | B1 | 8/2003 | Stemmer et al. |
| 6,605,430 | B1 | 8/2003 | Affholter et al. |
| 6,613,514 | B2 | 9/2003 | Patten et al. |
| 6,630,581 | B2 | 10/2003 | Dellinger et al. |
| 6,653,072 | B1 | 11/2003 | Patten et al. |
| 6,686,515 | B1 | 2/2004 | Lassner et al. |
| 6,703,240 | B1 | 3/2004 | Stemmer et al. |
| 6,716,631 | B1 | 4/2004 | delCardayre et al. |
| 6,825,001 | B2 | 11/2004 | Wackett et al. |
| 6,902,922 | B2 | 6/2005 | Ness et al. |
| 6,917,882 | B2 | 7/2005 | Selifonov et al. |
| 6,946,296 | B2 | 9/2005 | Patten et al. |
| 6,961,664 | B2 | 11/2005 | Selifonov et al. |
| 6,995,017 | B1 | 2/2006 | Stemmer |
| 7,024,312 | B1 | 4/2006 | Selifonov et al. |
| 7,057,026 | B2 | 6/2006 | Barnes et al. |
| 7,058,515 | B1 | 6/2006 | Selifonov et al. |
| 7,105,297 | B2 | 9/2006 | Minshull et al. |
| 7,148,054 | B2 | 12/2006 | delCardayre et al. |
| 7,193,077 | B2 | 3/2007 | Dellinger et al. |
| 7,220,566 | B2 | 5/2007 | Ness et al. |
| 7,271,258 | B2 | 9/2007 | Dellinger et al. |
| 7,288,375 | B2 | 10/2007 | Stemmer et al. |
| 7,384,387 | B1 | 6/2008 | Raillard et al. |
| 7,421,347 | B2 | 9/2008 | Selifonov et al. |
| 7,430,477 | B2 | 9/2008 | Selifonov et al. |
| 7,462,469 | B2 | 12/2008 | Bass et al. |
| 7,534,564 | B2 | 5/2009 | Patten et al. |
| 7,544,794 | B1 | 6/2009 | Brenner |
| 7,620,500 | B2 | 11/2009 | Mundorff et al. |
| 7,620,502 | B2 | 11/2009 | Selifonov et al. |
| 7,629,157 | B2 | 12/2009 | Davis et al. |
| 7,629,170 | B2 | 12/2009 | delCardayre et al. |
| 7,702,464 | B1 | 4/2010 | Emig et al. |
| 7,747,391 | B2 | 6/2010 | Gustafsson et al. |
| 7,747,393 | B2 | 6/2010 | Fox |
| 7,751,986 | B2 | 7/2010 | Gustafsson et al. |
| 7,776,598 | B2 | 8/2010 | Patten et al. |
| 7,783,428 | B2 | 8/2010 | Gustafsson et al. |
| 7,795,030 | B2 | 9/2010 | Minshull et al. |
| 7,807,356 | B2 | 10/2010 | Sampson et al. |
| 7,853,410 | B2 | 12/2010 | Selifonov et al. |
| 7,868,138 | B2 | 1/2011 | Stemmer et al. |
| 7,873,477 | B1 | 1/2011 | Gustafsson et al. |
| 7,873,499 | B2 | 1/2011 | Selifonov et al. |
| 7,904,249 | B2 | 3/2011 | Selifonov et al. |
| 7,957,912 | B2 | 6/2011 | Selifonov et al. |
| 7,981,614 | B2 | 7/2011 | Stemmer et al. |
| 8,014,961 | B2 | 9/2011 | Bass et al. |
| 8,029,988 | B2 | 10/2011 | Crameri et al. |
| 8,030,466 | B2 | 10/2011 | Shin et al. |
| 8,048,674 | B2 | 11/2011 | Minshull et al. |
| 8,058,001 | B2 | 11/2011 | Crameri et al. |
| 8,076,138 | B2 | 12/2011 | delCardayre et al. |
| 8,108,150 | B2 | 1/2012 | Mundorff et al. |
| 8,170,806 | B2 | 5/2012 | Selifonov et al. |
| 8,224,580 | B2 | 7/2012 | Mundorff et al. |
| 8,309,706 | B2 | 11/2012 | Dellinger et al. |
| 8,377,681 | B2 | 2/2013 | delCardayre et al. |
| 8,383,346 | B2 | 2/2013 | Colbeck et al. |
| 8,457,903 | B1 | 6/2013 | Emig et al. |
| 8,504,498 | B2 | 8/2013 | Fox |
| 8,589,085 | B2 | 11/2013 | Selifonov et al. |
| 8,762,066 | B2 | 6/2014 | Fox |
| 8,768,871 | B2 | 7/2014 | Fox |
| 8,808,989 | B1 | 8/2014 | Efcavitch et al. |
| 9,279,149 | B2 | 3/2016 | Efcavitch et al. |
| 9,410,197 | B2 | 8/2016 | Bergmann et al. |
| 9,593,326 | B2 | 3/2017 | Clark et al. |
| 9,695,470 | B2 | 7/2017 | Efcavitch et al. |
| 9,771,613 | B2 | 9/2017 | Efcavitch et al. |
| 10,041,110 | B2 | 8/2018 | Efcavitch et al. |
| 10,059,929 | B2 | 8/2018 | Efcavitch et al. |
| 10,059,986 | B2 | 8/2018 | Zhou et al. |
| 10,407,721 | B2 | 9/2019 | Liu et al. |
| 10,745,727 | B2 | 8/2020 | Chen et al. |
| 10,752,887 | B2 * | 8/2020 | Champion ............ C12N 15/70 |
| 2008/0220990 | A1 | 9/2008 | Fox |
| 2009/0312196 | A1 | 12/2009 | Colbeck et al. |
| 2012/0276074 | A1 | 11/2012 | Scharenberg et al. |
| 2016/0244787 | A1 | 8/2016 | Chen et al. |
| 2018/0023108 | A1 | 1/2018 | Chen et al. |

(56) References Cited

U.S. PATENT DOCUMENTS

| | | | |
|---|---|---|---|
| 2020/0190491 | A1 | 6/2020 | Efcavitch et al. |
| 2021/0164008 | A1 | 6/2021 | Chen et al. |

FOREIGN PATENT DOCUMENTS

| | | | |
|---|---|---|---|
| GB | 2598152 | A | 2/2022 |
| WO | 95/22625 | A1 | 8/1995 |
| WO | 95/33836 | A1 | 12/1995 |
| WO | 96/00787 | A1 | 1/1996 |
| WO | 96/07669 | A1 | 3/1996 |
| WO | 96/23807 | A1 | 8/1996 |
| WO | 97/0078 | A1 | 1/1997 |
| WO | 97/35966 | A1 | 10/1997 |
| WO | 98/27230 | A1 | 6/1998 |
| WO | 00/42651 | A1 | 7/2000 |
| WO | 01/25247 | A1 | 4/2001 |
| WO | 01/55451 | A1 | 8/2001 |
| WO | 01/75767 | A2 | 10/2001 |
| WO | 02/29003 | A2 | 4/2002 |
| WO | 03/048387 | A2 | 6/2003 |
| WO | 04/018493 | A1 | 3/2004 |
| WO | 04/018497 | A2 | 3/2004 |
| WO | 2009/008908 | A2 | 1/2009 |
| WO | 2009/151921 | A1 | 12/2009 |
| WO | 2009/152336 | A1 | 12/2009 |
| WO | 2010/110775 | A1 | 9/2010 |
| WO | 2010/144103 | A1 | 12/2010 |
| WO | 2012/177639 | A2 | 12/2012 |
| WO | 2014/139596 | A1 | 9/2014 |
| WO | 2015/159023 | A1 | 10/2015 |
| WO | 2015/168310 | A1 | 11/2015 |
| WO | 2015/168461 | A1 | 11/2015 |
| WO | 2016/064880 | A1 | 4/2016 |
| WO | 2016/128731 | A1 | 8/2016 |
| WO | 2016/139477 | A1 | 9/2016 |
| WO | 2017/216472 | A2 | 12/2017 |
| WO | 2018/085156 | A1 | 5/2018 |
| WO | 2018/138508 | A1 | 8/2018 |
| WO | 2018/215803 | A1 | 11/2018 |
| WO | 2018/217689 | A1 | 11/2018 |
| WO | 2019/135007 | A1 | 7/2019 |
| WO | 2020/072715 | A1 | 4/2020 |
| WO | 2020/077227 | A2 | 4/2020 |
| WO | 2020/081985 | A1 | 4/2020 |
| WO | 2020/099451 | A1 | 5/2020 |
| WO | 2020/120442 | A2 | 6/2020 |
| WO | 2020/141143 | A1 | 7/2020 |
| WO | 2020/161480 | A1 | 8/2020 |
| WO | 2020/165137 | A1 | 8/2020 |
| WO | 2020/229831 | A1 | 11/2020 |
| WO | 2020/239737 | A1 | 12/2020 |
| WO | 2021/018919 | A1 | 2/2021 |
| WO | 2021/018921 | A1 | 2/2021 |
| WO | 2021/058438 | A1 | 4/2021 |
| WO | 2021/094251 | A1 | 5/2021 |
| WO | 2021/116270 | A1 | 6/2021 |
| WO | 2021/122539 | A1 | 6/2021 |
| WO | 2021/170524 | A1 | 9/2021 |
| WO | 2021/213903 | A1 | 10/2021 |
| WO | 2021/247851 | A2 | 12/2021 |
| WO | 2021/254934 | A1 | 12/2021 |
| WO | 2022/013094 | A1 | 1/2022 |
| WO | 2022/063835 | A1 | 3/2022 |
| WO | 2022/090323 | A1 | 5/2022 |
| WO | 2023/041931 | A1 | 3/2023 |
| WO | 2023/083997 | A2 | 5/2023 |
| WO | 2023/083999 | A2 | 5/2023 |
| WO | 2023/240202 | A2 | 12/2023 |

OTHER PUBLICATIONS

Ngo et al. in The Protein Folding Problem and Tertiary Structure Prediction, 1994, Merz et al. (ed.), Birkhauser, Boston, MA, pp. 433 and 492-495.*

Koiwai et al., Nuc Acids Res, vol. 14, No. 14, pp. 5777-5792, 1986.*

UniProt Accession No. A0A674H6A5, Jun. 2025.*

Tiwari, S., et al., "Prediction of probable genes by Fourier analysis of genomic sequences," Comput. Appl. Biosci. 13 (3):263-270 [1997].

Truppo, M.D., et al., "Development of an Improved Immobilized CAL-B for the Enzymatic Resolution of a Key Intermediate to Odanacatib," Organic Process Research & Development, 15:1033-1035 (2011).

Uberbacher, E.C., et al., "Discovering and Understanding Genes in Human DNA Sequence Using GRAIL," Methods Enzymol., 266:259-281 [1996].

Villa-Komaroff, L., et al., "A bacterial clone synthesizing proinsulin," Proc. Natl Acad. Sci. USA, 75:3727-3731 (1978).

Wada, K., et al., "Codon usage tabulated from the GenBank genetic sequence data," Nucl. Acids Res., 20:2111-2118 [1992].

Wells, J.A., et al., "Cassette mutagenesis: an efficient method for generation of multiple mutations at defined sites," Gene, 34:315-323 (1985).

Wetmur, J. G., "DNA Probes: Applications of the Principles of Nucleic Acid Hybridization," Crit Rev Biochem Mol Biol, 26(3/4):227-259 (1991).

Wright, F., "The 'effective number of codons' used in a gene," Gene 87:23-29 [1990].

Yi, S., et al., "Covalent immobilization of omega-transaminase from Vibrio fluvialis JS17 on chitosan beads," Process Biochemistry 42(5): 895-898 (2007).

Zhang, J-H., et al., "Directed evolution of a fucosidase from a galactosidase by DNA shuffling and screening ," Proc. Nat. Acad. Sci., U.S.A., 94:4504-4509 (1997).

Zhao, H., et al., "Molecular evolution by staggered extension process (StEP) in vitro recombination," Nat. Biotechnol., 16:258-261 (1998).

NCBI Accession No. XM_027908988.1 dated Jan. 24, 2019 "Predicted: Empidonax Traillil DNA nucleotidylaxotransferase (NDTT), mRNA"; https//www.ncbi.nim.nih.gov/nucleotide/XM_027908988.1.

Knight, Anders, "Engineering Enzymes to Produce High Purity Synthetic DNA," Enzyme Engineering (conference), May 23, 2022.

Miller, Matt and Efcavitch, Bill, "Breaking the Barrier to Long, High Purity Synthetic DNA," SynBio Beta Built with Biology (conference), Apr. 14, 2022.

Lutz, Stefan, "Engineering Enzyme Products," Canadian Chemistry Conference & Exhibition, Jun. 14, 2022.

Krawczyk, Mikayla, et al., "Engineering Terminal Deoxynucleotidyl Transferase to Produce Long, High Purity Synthetic DNA," Gordon Research Conference, Jul. 8, 2022.

Zhe, Rui, "Engineering Enzymes to Produce High Purity Synthetic DNA," Biochemical and Molecular Engineering (conference), Jun. 26, 2022.

Lutz, Stefan, "Making Complex Molecules—Engineering Biocatalysts for Use in Sustainable Manufacturing," Biocatalysis (conference), Aug. 30, 2022.

Codexis, Inc., Q2 2021 Earnings Press Release, Aug. 5, 2021.

Codexis, Inc., Codexis Corporate Presentation Mar. 2022, available at www.codexis.com. Published Mar. 8, 2022.

Codexis, Inc., Codexis Corporate Presentation Nov. 2021, available at www.codexis.com. Published Nov. 15, 2021.

Altschul, S., et al., "Basic local alignment search tool," J. Mol. Biol., 215: 403-410 (1990).

Altschul, S.F., et al., "Gapped BLAST and PSI-BLAST: a new generation of protein database search programs," Nucleic Acids Res., 25(17):3389-3402 (1997).

Baldino, Jr., F., et al., "High-Resolution in Situ Hybridization Histochemistry," Methods Enzymology, 168:761-777 (1989).

Batzer, M.A., "Erratum: Structure and variability of recently inserted Alu family members", Nucleic Acids Res 19:698-699 [1991].

Beaucage, S.L., et al., "Deoxynucleoside phosphoamidites—A new class of key intermediates for deoxypolynucleotide synthesis," Tetrahedron Letters, 22(20):1859-62 (1981).

(56) References Cited

OTHER PUBLICATIONS

Bentolila, L.A., et al., "The two isoforms of mouse terminal deoxynucleotidyl transferase differ in both the ability to add N regions and subcellular localization," EMBO, 14(17):4221-4229 (1995).
Black, M.E., et al., "Creation of drug-specific herpes simplex virus type 1 thymidine kinase mutants for gene therapy," Proc Natl Acad Sci USA, 93:3525-3529 (1996).
Bollum, F.J., "Oligodeoxyribonucleotide-primed Reactions Catalyzed by Calf Thymus PolymeraseM," J. Biol. Chem., 237(6):1945-1949 [1962].
Bolton, E.T., et al., "A General Method for the Iisolation of RNA Complementary to DNA," Proc. Natl. Acad. Sci. USA 48:1390 ( 1962).
Botstein, D., et al., "Strategies and applications of in vitro mutagenesis," Science, 229(4719):1193-1201 [1985].
Breslauer, K.J., et al., "Predicting DNA duplex stability from the base sequence," Proc. Natl. Acad. Sci. USA, 83:3746-3750 (1986).
Caldwell, R.C., et al., "Mutagenic PCR," PCR Methods Appl., 3:S136-S140 (1994).
Carter, P., "Site-directed mutagenesis," Biochem. J., 237:1-7 (1986).
Christians, F.C., et al., "Directed evolution of thymidine kinase for AZT phosphorylation using DNA family shuffling," Nat. Biotechnol., 17:259-264 (1999).
Chua, J.P.S., et al., "Evolving a Thermostable Terminal Deoxynucleotidyl Transferase," ACS Synth. Biol., 9:1725-1735 [2020].
Crameri, A., et al., "DNA shuffling of a family of genes from diverse species accelerates directed evolution", Nature, 391:288-291 (1998).
Crameri, A., et al., "Improved green fluorescent protein by molecular evolution using DNA shuffling," Nat. Biotechnol., 14(3):315-319 (1996).
Crameri, A., et al., "Molecular evolution of an arsenate detoxification pathway by DNA shuffling," Nat. Biotechnol., 15 (5):436-438 (1997).
Dale, S.J., et al., "Oligonucleotide-directed random mutagenesis using the phosphorothioate method," Methods Mol. Biol., 57:369-74 (1996).
De Boer, H.A., et al., "The tac promoter: A functional hybrid derived from the trp and lac promoters," Proc. Natl Acad. Sci. USA, 80: 21-25 (1983).
Dominguez, O., et al., "DNA polymerase mu (Pol μ), homologous to TdT, could act as a DNA mutator in eukaryotic cells," EMBO, 19(7):1731-1742 (2000).
Fasman, G.D., CRC Practical Handbook of Biochemistry and Molecular Biology, CRC Press, Boca Raton, FL, pp. 3-70 [1989].
Freier, S.M., et al., "Improved free-energy parameters for predictions of RNA duplex stability," Proc. Natl. Acad. Sci USA, 83:9373-9377 (1986).
Guo, Z., et al., "3'-End-Forming Signals of Yeast mRNA," Mol. Cell. Biol., 15(11):5983-5990 [1995].
Henaut and Danchin in Neidhardt et al. [eds.], *Escherichia coli* and *Salmonella*, "Analysis and predictions from *Escherichia coli* Sequences, or *E. coli* in silico," ASM Press, Washington D.C., [1987], pp. 2047-2066.
Henikoff, S., et al., "Amino acid substitution matrices from protein blocks," Proc. Natl. Acad. Sci., 89:10915-10919 (1992).
Kierzek, R., et al., "Polymer-Supported RNA Synthesis and Its Application To Test the Nearest-Neighbor Model for Duplex Stability," Biochemistry, 25:7840-7846 (1986).
Koszelewski, D., et al., "Immobilization of omega-transaminases by encapsulation in a sol-gel/celite matrix," Journal of Molecular Catalysis B: Enzymatic, 63: 39-44 (2010).
Kramer, B., et al., "Different base/base mismatches are corrected with different efficiencies by the methyl-directed DNA mismatch-repair system of *E. coli*," Cell, 38(3):879-887, 1984.
Ling, M., et al., "Approaches to DNA Mutagenesis:An Overview," Anal. Biochem., 254:157-78 (1997).
Lu, X., et al., "Enzymatic DNA Synthesis by Engineering TerminalDeoxynucleotidyl Transferase," ACS Catalysis, 12:2988-2997 [2022].
Martin, A.R., et al., "Characterization of free and immobilized (S)-aminotransferase for acetophenone production," Applied Microbiology and Biotechnology, 76(4): 843-851 (2007).
Mateo, C., et al., "Epoxy sepabeads: a novel epoxy support for stabilization of industrial enzymes via very intense multipoint covalent attachment," Biotechnology Progress 18(3):629-34 (2002).
Matthes, H.W.D., et al., "Simultaneous rapid chemical synthesis of over one hundred oligonucleotides on a microscale," EMBO J., 3(4):801-05 (1984).
McInerney, J.O., "GCUA: general codon usage analysis," Bioinformatics, 14(4):372-73 [1998].
Minshull, J., et al., "Protein evolution by molecular breeding," Curr. Op. Chem. Biol., 3(3):284-290 (1999).
Nakamura, Y., et al., "Codon usage tabulated from international DNA sequence databases: status for the year 2000," Nucl. Acids Res., 28:292 [2000].
Needleman, S., et al., "A general method applicable to the search for similarities in the amino acid sequence of two proteins," J. Mol. Biol. 48:443-453 (1970).
Pearson, W.R., "Improved tools for biological sequence comparison," Proc. Nat'l. Acad. Sci. USA, 85:2444-2448 (1988).
Romanos, M.A., et al., "Foreign gene expression in yeast: a review," Yeast 8:423-488 [1992].
Rychlik, W., et al., "Optimization of the annealing temperature for DNA amplification in vitro," Nucleic Acids Res, 18 (21):6409-6412 (1990).
Schaudy, E., et al., "Sequence Preference and Initiator Promiscuity for De Novo DNA Synthesis by Terminal Deoxynucleotidyl Transferase," ACS Synth. Biol., 10:1750-1760 [2021].
Simonen, M., et al., "Protein Secretion in Bacillus Species," Microbiological Reviews, 57:109-137 (1993).
Smith, M., "In vitro mutagenesis," Ann. Rev. Genet., 19:423-462 (1985).
Smith, T., et al., "Comparison of Biosequences," Adv. Appl. Math, 2:482-489 (1981).
Stellwagen, E., "Dye Affinity Chromatography," Current Protocols in Protein Science, Chapter 9, Unit 9.2-9.2.16 [2001].
Stemmer, W., "DNA Shuffling by Random Fragmentation and Reassembly: In vitro Recombination for Molecular Evolution," Proc. Natl. Acad. Sci. USA, 91:10747-10751 (1994).
Stemmer, W.P.C., "Rapid evolution of a protein in vitro by DNA shuffling", Nature, 370:389-391 (1994).
Stenico, M., et al., "Codon usage in Caenorhabditis elegans: delineation of translational selection and mutational biases," Nucl. Acids Res. 22(13):2437-46 [1994].
Suggs, S.V., et al., "Use of synthetic oligodeoxyribonucleotides for the isolation of specific cloned DNA sequences," In Developmental Biology Using Purified Genes (Brown et al., eds.), pp. 683-693, Academic Press (1981).

* cited by examiner

ENGINEERED TERMINAL DEOXYNUCLEOTIDYL TRANSFERASE VARIANTS

The present application claims priority to U.S. Prov. Pat. Appln. Ser. No. 63/256,353, filed Oct. 15, 2021, and U.S. Prov. Pat. Appln. Ser. No. 63/329,777, filed Apr. 11, 2022, both of which are incorporated by reference in their entireties, for all purposes.

TECHNICAL FIELD

The present invention provides engineered terminal deoxynucleotidyl transferase (TdT) polypeptides useful in template-independent polynucleotide synthesis using a nucleoside triphosphate-3'-O-removable blocking group (NTP-3'-O-RBG), as well as compositions and methods of utilizing these engineered polypeptides.

REFERENCE TO SEQUENCE LISTING, TABLE OR COMPUTER PROGRAM

The official copy of the Sequence Listing is submitted concurrently with the specification as an XML file, with a file name of "CX9-217US2_ST26.xml", a creation date of Oct. 13, 2022, and a size of 13.3 megabytes. The Sequence Listing is part of the specification and is incorporated in its entirety by reference herein.

BACKGROUND

Synthetic biology is becoming established in a diverse range of high value, high growth markets. From food and agriculture to therapeutics, diagnostics, and vaccines; tools such as gene editing, DNA sequencing and gene synthesis are being used to build value-added products with advanced functionality (e.g., cell bioreactors, etc.) and desired end products (e.g., drugs, chemicals, etc.). The barrier to widespread implementation of these technologies is the ability to efficiently synthesize DNA and other polynucleotides. Traditional methods of DNA synthesis use phosphoramidite DNA synthesis chemistry, which is limited to producing short oligonucleotides of approximately 200 basepairs (Beaucage & Caruthers. (1981). Tetrahedron Lett. 22 (20): 1859.) Phosphoramidite DNA synthesis has the additional drawback of generating high amounts of toxic waste.

In the early 1980's, phosphoramidite DNA synthesis was a critical development that enabled the genomics revolution and allowed new ways of researching diseases and prospective cures. Over the last forty years, however, advances in polynucleotide synthesis methods have been limited and have not kept pace with progress in other areas molecular biology. New methods of synthesizing long, pure strands of natural DNA and other polynucleotides are necessary to enable current opportunities in synthetic biology.

Template-Independent Enzymatic Synthesis

Enzymatic synthesis may facilitate production of long polynucleotides (>200 base pairs) while minimizing toxic waste. A variety of prokaryotic and eukaryotic DNA and RNA polymerases are known to naturally synthesize polynucleotides of thousands of base pairs or more. Most of these polymerases function during DNA replication associated with cell division or transcription of RNA from DNA associated with gene or protein expression. Both of these processes involve template-dependent polynucleotide synthesis, wherein the polymerase uses an existing template polynucleotide strand to synthesize a complementary polynucleotide strand.

The potential of template-independent enzymatic polynucleotide synthesis to produce defined sequences has long been recognized. One early report suggested using NTPs with blocked 3'-OH groups to allow stepwise addition of specific nucleotide residues (Bollum. (1962). JBC, 237, 1945-1949).

However, few polymerases are known to catalyze template-independent polynucleotide synthesis. These include polymerase lambda, polymerase mu, and terminal deoxynucleotidyl transferase (TdT), all members of the X family of DNA polymerases, many of which participate in DNA repair processes (Dominguez et al. (2000). EMBO, 19(7), 1731-1742.) Of these, TdT is known to generate diversity in antigen receptors by indiscriminately adding nucleosides to the 3' end of a single-stranded polynucleotide in a template-independent process (Bentolila et al. (1995). EMBO, 14(17), 4221-4229.)

Others have published a method of polynucleotide synthesis using a nucleoside 5'-triphosphate with a 3'-OH position protected with a removable blocking moiety and, specifically, a template-independent polynucleotide polymerase, including a terminal deoxynucleotidyl transferase (U.S. Pat. No. 5,763,594). The blocking group, also known to those skilled in the art as an inhibitor or terminating group, may include a variety of groups that prevent the TdT from adding additional NTPs to the nascent polynucleotide chain, by blocking access to the active site. This may include charged molecules, large molecules and moieties, or other blocking groups known to those skilled in the art. Appropriate removable blocking groups may include carbonitriles, phosphates, carbonates, carbamates, esters, ethers, borates, nitrates, sugars, phosphoramidates, phenylsulfenates, sulfates and sulfones. Other 3'-OH blocking groups are also known in the art, including 3'-O-amines and methylamines (U.S. Pat. No. 7,544,794) and 3'-O-azides (U.S. Pat. No. 10,407,721).

Although initially promising, use of 3'-OH blocked NTPs in template-independent synthesis catalyzed by TdT has proven difficult in practice, as the blocked 3'-OH does not allow the enzyme to recognize the polynucleotide as a substrate for additional synthesis steps.

Recently several reports have described template-independent synthesis methods that use modified NTPs with blocking groups attached to the purine or pyrimidine base, leaving the 3'-OH unmodified and available for additional rounds of synthesis. These base blocking groups may include a cleavable linker that allows removal of the blocking group after each NTP addition step. The cleavable linker may also be attached to a detectable label (U.S. Pat. No. 7,057,026, among others). A variety of cleavable linkers are known to those skilled in the art. These include linkers attached via reducible disulfide bonds, photocleavable, electrophilic or nucleophilic, pH sensitive, temperature sensitive, and linkers cleaved by enzymes. One drawback to using cleavable linkers is that, typically, some atoms of the linker moiety remain attached to the NTP following cleavage, leaving a "scar" that may interfere with synthesis of a complementary strand after initial template-independent synthesis of the primary polynucleotide strand.

Recently, modified NTPs with bases attached to blocking groups with cleavable linkers that are "scarless" and leave the nascent DNA ready for the next round of synthesis have been developed. In one example, the blocking group and cleavable linker are attached to the base via a disulfide bond.

Upon addition of a reducing agent, the blocking group is removed and the remaining atoms of the linker self-cyclize to leave the nascent DNA free of any linker atoms (U.S. Pat. Nos. 8,808,989, 9,695,470, 10,041,110). Methods of using NTPs attached to cleavable blocking groups to synthesize polynucleotides are known, including using a microfluidic device or ink jet printing technology (U.S. Pat. No. 9,279,149). An exonuclease may also be used in a method to synthesize polynucleotides to shorten or completely degrade polynucleotide strands that have not successfully added an NTP after the polynucleotide extension step and prior to removing the blocking group (U.S. Pat. No. 9,771,613).

However, NTP bases labeled with bulky blocking groups attached via cleavable linkers are not optimal for efficient synthesis of long oligonucleotides. The large labels may negatively impact enzyme kinetics, and linker scars may lead to an unacceptable rate of misincorporation when synthesizing the complementary strand. Additionally, larger linkers and necessary removable steps may increase the cost, time, and inefficiency of the reaction, rendering these methods economically infeasible.

Recently, several groups have explored modifying the structure or amino acid sequence of TdT or other polymerases to allow template-independent synthesis using 3'-OH blocked groups. Efcavitch et al. describes incorporation of 3'-OH modified dNTPs by TdT in template-independent synthesis using a murine or bacterial TdT with substituted amino acid residues (U.S. Pat. No. 10,059,929). Other reports describe engineered bovine and gar (*Lepisosteus oculatus*) TdTs that displayed improved activity over wild-type TdT (U.S. Pat. No. 10,745,727, PCT/GB2020/050247). Similarly, a variety of mutations have been described to improve the activity of Pol X family enzymes (WO 2017216472 A2). Finally, an N-terminal truncation of the BRCT domain (or alternatively mutation of the BRCT domain) of TdT has also been described as enhancing activity in the addition of reversibly blocked NTPs to the 3'-OH of a nucleic acid (US20210164008A1).

However, no feasible methods of template-independent enzymatic synthesis of long polynucleotides are currently known or commercially available, despite the recognized value of this technology and intensive research efforts devoted to resolving challenges in this field. Improved engineered TdT enzymes are necessary to enable template-independent enzymatic synthesis of long polynucleotides or oligonucleotides of defined sequence using nucleoside triphosphates with 3'-O-removable blocking groups.

SUMMARY

The present invention provides engineered terminal deoxynucleotidyl transferase (TdT) polypeptides useful in template-independent polynucleotide synthesis using a nucleoside triphosphate-3'-O-removable blocking group (NTP-3'-O-RBG), as well as compositions and methods of utilizing these engineered polypeptides. The TdTs of the present invention are variants of a predicted splice variant of the wild-type gene from *Empidonax traillil* (SEQ ID NO:2). These engineered TdTs are capable of adding nucleoside triphosphates with a 3'-O-removable blocking group to the 3'-OH end of a growing oligonucleotide or polynucleotide chain in a template-independent manner. After removal of the blocking group, additional rounds of NTP addition can be used to synthesize a polynucleotide with a defined sequence of bases without using a complementary template strand as a guide for NTP incorporation (template-independent synthesis).

In some embodiments, the present invention provides an engineered TdT polypeptide comprising an amino acid sequence having at least 60%, 70%, 80%, 85%, 90%, 91%, 92%, 93%, 94%, 95%, 96%, 97%, 98%, 99% sequence identity to a reference sequence of SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636. comprising at least one substitution or one substitution set at one or more positions, wherein the positions are numbered with reference to SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636 and wherein the engineered TdT polypeptide has improved thermostability, increased activity at elevated temperatures, increased soluble expression, decreased by-product formation, increased specific activity on NTP-3'-O-RBG substrates, and/or increased activity on various oligo acceptor substrates as compared to a wild-type TdT or other TdTs known to those of skill in the art. These engineered TdT polypeptides with one or more amino acid residue differences or residue difference sets are described, below, in the detailed description of the invention.

In some additional embodiments, the engineered polypeptide comprises an amino acid sequence with at least 60% sequence identity to any even-numbered sequence set forth in SEQ ID NO: 6 to SEQ ID NO: 3592 and SEQ ID NO: 3698 to SEQ ID NO: 6766.

The present invention also provides an engineered polynucleotide encoding at least one engineered polypeptide described in the above paragraphs. In some embodiments, the engineered polynucleotide comprises the odd-numbered sequences set forth in SEQ ID NO: 5 to SEQ ID NO: 3591 and SEQ ID NO: 3697 to SEQ ID NO: 6765.

The present invention further provides vectors comprising at least one engineered polynucleotide described above. In some embodiments, the vectors further comprise at least one control sequence.

The present invention also provides host cells comprising the vectors provided herein. In some embodiments, the host cell produces at least one engineered polypeptide provided herein.

The present invention further provides methods of producing an engineered TdT polypeptide, comprising the steps of culturing the host cell provided herein under conditions such that the engineered polynucleotide is expressed and the engineered polypeptide is produced. In some embodiments, the methods further comprise the step of recovering the engineered polypeptide.

DESCRIPTION OF THE INVENTION

Figure 1:
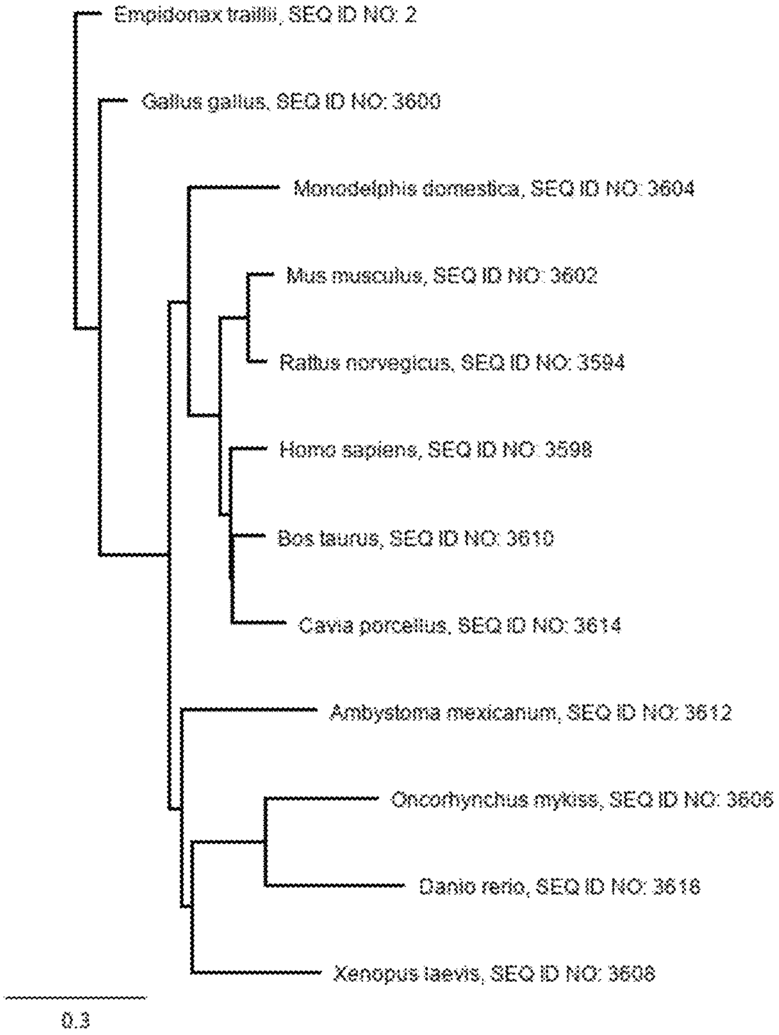
FIG. 1 depicts the full-length TdT variants and the relationships of the enzymes based on sequence conservation as a phylogenetic tree.

Unless defined otherwise, all technical and scientific terms used herein generally have the same meaning as commonly understood by one of ordinary skill in the art to which this invention pertains. Generally, the nomenclature used herein and the laboratory procedures of cell culture, molecular genetics, microbiology, organic chemistry, analytical chemistry and nucleic acid chemistry described below are those well-known and commonly employed in the art. Such techniques are well-known and described in numerous texts and reference works well known to those of skill in the art. Standard techniques, or modifications thereof, are used for chemical syntheses and chemical analyses. All patents, patent applications, articles and publications mentioned herein, both supra and infra, are hereby expressly incorporated herein by reference.

Although any suitable methods and materials similar or equivalent to those described herein find use in the practice of the present invention, some methods and materials are described herein. It is to be understood that this invention is not limited to the particular methodology, protocols, and reagents described, as these may vary, depending upon the context they are used by those of skill in the art. Accordingly, the terms defined immediately below are more fully described by reference to the invention as a whole.

It is to be understood that both the foregoing general description and the following detailed description are exemplary and explanatory only and are not restrictive of the present invention. The section headings used herein are for organizational purposes only and not to be construed as limiting the subject matter described. Numeric ranges are inclusive of the numbers defining the range. Thus, every numerical range disclosed herein is intended to encompass every narrower numerical range that falls within such broader numerical range, as if such narrower numerical ranges were all expressly written herein. It is also intended that every maximum (or minimum) numerical limitation disclosed herein includes every lower (or higher) numerical limitation, as if such lower (or higher) numerical limitations were expressly written herein.

As used in this specification and the appended claims, the singular forms "a", "an" and "the" include plural referents unless the context clearly indicates otherwise. Thus, for example, reference to "a polypeptide" includes more than one polypeptide. Similarly, "comprise," "comprises," "comprising" "include," "includes," and "including" are interchangeable and not intended to be limiting.

It is to be understood that where descriptions of various embodiments use the term "comprising," those skilled in the art would understand that in some specific instances, an embodiment can be alternatively described using language "consisting essentially of" or "consisting of" It is to be further understood that where descriptions of various embodiments use the term "optional" or "optionally" the subsequently described event or circumstance may or may not occur, and that the description includes instances where the event or circumstance occurs and instances in which it does not. It is to be understood that both the foregoing general description, and the following detailed description are exemplary and explanatory only and are not restrictive of this disclosure. The section headings used herein are for organizational purposes only and not to be construed as limiting the subject matter described.

Abbreviations:

The abbreviations used for the genetically encoded amino acids are conventional and are as follows:

| Amino Acid | Three-Letter | One-Letter Abbreviation |
|---|---|---|
| Alanine | Ala | A |
| Arginine | Arg | R |
| Asparagine | Asn | N |
| Aspartate | Asp | D |
| Cysteine | Cys | C |
| Glutamate | Glu | E |
| Glutamine | Gln | Q |
| Glycine | Gly | G |
| Histidine | His | H |
| Isoleucine | Ile | I |
| Leucine | Leu | L |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

When the three-letter abbreviations are used, unless specifically preceded by an "L" or a "D" or clear from the context in which the abbreviation is used, the amino acid may be in either the L- or D-configuration about α-carbon ($C_\alpha$). For example, whereas "Ala" designates alanine without specifying the configuration about the α-carbon, "D-Ala" and "L-Ala" designate D-alanine and L-alanine, respectively.

When the one-letter abbreviations are used, upper case letters designate amino acids in the L-configuration about the α-carbon and lower case letters designate amino acids in the D-configuration about the α-carbon. For example, "A" designates L-alanine and "a" designates D-alanine. When polypeptide sequences are presented as a string of one-letter or three-letter abbreviations (or mixtures thereof), the sequences are presented in the amino (N) to carboxy (C) direction in accordance with common convention.

The abbreviations used for the genetically encoding nucleosides are conventional and are as follows: adenosine (A); guanosine (G); cytidine (C); thymidine (T); and uridine (U). These abbreviations are also used interchangeably for nucleosides and nucleotides (nucleosides with one or more phosphate groups). Unless specifically delineated, the abbreviated nucleosides or nucleotides may be either ribonucleosides (or ribonucleotides) or 2'-deoxyribonucleosides (or 2'-deoxyribonucleotides). The nucleosides or nucleotides may also be modified at the 3' position. The nucleosides or nucleotides may be specified as being either ribonucleosides (or ribonucleotides) or 2'-deoxyribonucleosides (or 2'-deoxyribonucleotides) on an individual basis or on an aggregate basis. When nucleic acid sequences are presented as a string of one-letter abbreviations, the sequences are presented in the 5' to 3' direction in accordance with common convention, and the phosphates are not indicated.

Definitions

In reference to the present invention, the technical and scientific terms used in the descriptions herein will have the meanings commonly understood by one of ordinary skill in the art, unless specifically defined otherwise. Accordingly, the following terms are intended to have the following meanings.

"EC" number refers to the Enzyme Nomenclature of the Nomenclature Committee of the International Union of Biochemistry and Molecular Biology (NC-IUBMB). The IUBMB biochemical classification is a numerical classification system for enzymes based on the chemical reactions they catalyze.

"ATCC" refers to the American Type Culture Collection whose biorepository collection includes genes and strains.

"NCBI" refers to National Center for Biological Information and the sequence databases provided therein.

"Protein," "polypeptide," and "peptide" are used interchangeably herein to denote a polymer of at least two amino acids covalently linked by an amide bond, regardless of length or post-translational modification (e.g., glycosylation, phosphorylation, lipidation, myristilation, ubiquitination, etc.). Included within this definition are D- and L-amino acids, and mixtures of D- and L-amino acids, as well as polymers comprising D- and L-amino acids, and mixtures of D- and L-amino acids.

"Amino acids" are referred to herein by either their commonly known three-letter symbols or by the one-letter symbols recommended by IUPAC-IUB Biochemical Nomenclature Commission. Nucleotides, likewise, may be referred to by their commonly accepted single letter codes.

As used herein, "polynucleotide," "oligonucleotide," and "nucleic acid" are used interchangeably herein and refer to two or more nucleosides or nucleotides that are covalently linked together. The polynucleotide may be wholly comprised of ribonucleotides (i.e., RNA), wholly comprised of 2' deoxyribonucleotides (i.e., DNA), wholly comprised of other synthetic nucleotides or comprised of mixtures of synthetic, ribo- and/or 2' deoxyribonucleotides. The polynucleotides may also include nucleotides with substitutions, including 2' substitutions (e.g., 2'-flouro or 2'-O-methyl). While the nucleosides will typically be linked together via standard phosphodiester linkages, the polynucleotides may include one or more non-standard linkages, including but not limited to phosphothiolated linkages. The polynucleotide may be single-stranded or double-stranded, or may include both single-stranded regions and double-stranded regions. Moreover, while a polynucleotide will typically be composed of the naturally occurring encoding nucleobases (i.e., adenine, guanine, uracil, thymine and cytosine), it may include one or more modified and/or synthetic nucleobases, such as, for example, inosine, xanthine, hypoxanthine, etc. In some embodiments, such modified or synthetic nucleobases are nucleobases encoding amino-acid sequences. Nucleobases that are modified or synthetic may comprise any known or hypothetical or future discovered modification or structure that would be recognized by one of skill in the art as a modified or synthetic nucleobase. Similarly, the terms "polynucleotide," "oligonucleotide," and "nucleic acid" are intended to comprise any modified or synthetic structure that is now known or discovered in the future that would be recognized by one of skill in the art as being or having the function of a "polynucleotide," "oligonucleotide," or "nucleic acid." An example of a modified or synthetic structure having the function of a "polynucleotide," "oligonucleotide," or "nucleic acid" is PNA or peptide nucleic acid.

As used herein, "oligo acceptor substrate" and "acceptor substrate" and "growing oligo acceptor substrate strand" and "growing polynucleotide strand" are used interchangeably herein and refer to any oligo or nucleotide chain or similar moiety with an exposed 3'-OH that may be recognized by a wild-type TdT or polymerase or an engineered TdT or polymerase of the current disclosure as a substrate for nucleoside addition or synthesis. In some embodiments, the acceptor substrate may be single stranded. In yet other embodiments, the acceptor substrate may be double stranded or partially doubled stranded. In some embodiments, the acceptor substrate may comprise a nucleotide chain consisting of 1-10 NTPs, 5-20 NTPs, 15-50 NTPs, 30-100 NTPs or greater than 100 NTPs. In some embodiments, the acceptor substrate may comprise a chemical moiety that is not a nucleotide chain but contains a free —OH capable of being recognized as a substrate by a wild-type or engineered TdT. Exemplary oligo acceptor substrates are provided in the Examples.

As used herein, "nucleoside triphosphate-3'-O-removable blocking group" and "nucleotide triphosphate-3'-O-removable blocking group" and "NTP-3'-O-RBG" are used interchangeably herein and refer to a ribonucleoside triphosphate or a deoxyribonucleoside triphosphate or a synthetic or nucleoside triphosphate composed of an alternate or modified sugar with a removable blocking group attached at the 3'OH of the sugar moiety.

As used herein, "oligo acceptor product" and "oligo acceptor extension product" are used interchangeably herein and refer to the product of a NTP-3'-O-RBG substate and an oligo acceptor substrate, wherein a TdT or related polymerase has catalyzed the extension or addition of the NTP-3'-O-RBG to the oligo acceptor substrate.

As used herein, "removable blocking group" and "blocking group" and "terminator group" and "inhibitor group" and related variations of these terms are used interchangeably herein and refer to a chemical group that would hinder addition of a second NTP-3'-O-RBG substrate to the 3' end of the growing oligo acceptor substrate strand prior to removal of the removable blocking from the first round of addition. In some embodiments, the NTP-3'-O-RBG substrate may comprise a removable blocking group selected from the group consisting of NTP-3'-O—$NH_2$, or NTP-3'-O—$PO_3$. In some embodiments, the NTP-3'-O-RBG may have a natural purine or pyrimidine base, such as adenine, guanine, cytosine, thymine, or uridine. In some embodiments, NTP-3'-O-RBG may have an unnatural base analog such as inosine, xanthine, hypoxanthine or another base analog, as is known in the art.

As used herein, "template-independent synthesis" refers to synthesis of an oligonucleotide or a polynucleotide without the use of template strand as a guide for synthesis of a complementary oligo or polynucleotide strand. Thus, template-independent synthesis refers to an iterative process, whereby, success NTPs are added to a growing oligo or nucleotide chain or acceptor substrate. Template-independent synthesis may be in a sequence defined manner or may be random, as is the case with the wild-type TdT in creating antigen receptor diversity. Processes for template-independent synthesis are further described herein.

"Coding sequence" refers to that portion of a nucleic acid (e.g., a gene) that encodes an amino acid sequence of a protein.

"Naturally-occurring" or "wild-type" refers to the form found in nature. For example, a naturally occurring or wild-type polypeptide or polynucleotide sequence is a sequence present in an organism that can be isolated from a source in nature and which has not been intentionally modified by human manipulation.

As used herein, "recombinant," "engineered," and "non-naturally occurring" when used with reference to a cell, nucleic acid, or polypeptide, refer to a material, or a material corresponding to the natural or native form of the material, that has been modified in a manner that would not otherwise exist in nature. In some embodiments, the cell, nucleic acid or polypeptide is identical a naturally occurring cell, nucleic acid or polypeptide, but is produced or derived from synthetic materials and/or by manipulation using recombinant techniques. Non-limiting examples include, among others, recombinant cells expressing genes that are not found within the native (non-recombinant) form of the cell or express native genes that are otherwise expressed at a different level.

"Percentage of sequence identity" and "percentage homology" are used interchangeably herein to refer to comparisons among polynucleotides or polypeptides, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences. Optimal alignment of sequences for comparison can be conducted, e.g., by the local homology algorithm of Smith and Waterman (Smith and Waterman, Adv. Appl. Math., 2:482 [1981]), by the homology alignment algorithm of Needleman and Wunsch (Needleman and Wunsch, J. Mol. Biol., 48:443 [1970]), by the search for similarity method of Pearson and Lipman (Pearson and Lipman, Proc. Natl. Acad. Sci. USA 85:2444 [1988]), by computerized implementations of these algorithms (e.g., GAP, BESTFIT, FASTA, and TFASTA in the GCG Wisconsin Software Package), or by visual inspection, as known in the art. Examples of algorithms that are suitable for determining percent sequence identity and sequence similarity include, but are not limited to the BLAST® and BLAST® 2.0 algorithms, which are described by Altschul et al. (See, Altschul et al., J. Mol. Biol., 215: 403-410 [1990]; and Altschul et al., Nucl. Acids Res., 3389-3402 [1977], respectively). Software for performing BLAST® analyses is publicly available through the National Center for Biotechnology Information website. This algorithm involves first identifying high scoring sequence pairs (HSPs) by identifying short words of length W in the query sequence, which either match or satisfy some positive-valued threshold score T when aligned with a word of the same length in a database sequence. T is referred to as, the neighborhood word score threshold (Altschul et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST® algorithm parameters W, T, and X determine the sensitivity and speed of the alignment. The BLASTN® program (for nucleotide sequences) uses as defaults a wordlength (W) of 11, an expectation (E) of 10, M=5, N=−4, and a comparison of both strands. For amino acid sequences, the BLASTP® program uses as defaults a wordlength (W) of 3, an expectation (E) of 10, and the BLOSUM62 scoring matrix (See, Henikoff and Henikoff, Proc. Natl. Acad. Sci. USA 89:10915 [1989]). Exemplary determination of sequence alignment and % sequence identity can employ the BESTFIT or GAP programs in the GCG Wisconsin Software package (Accelrys, Madison WI), using default parameters provided.

"Reference sequence" refers to a defined sequence used as a basis for a sequence comparison. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptide are typically performed by comparing sequences of the two polynucleotides or polypeptides over a "comparison window" to identify and compare local regions of sequence similarity. In some embodiments, a "reference sequence" can be based on a primary amino acid sequence, where the reference sequence is a sequence that can have one or more changes in the primary sequence. For instance, a "reference sequence based on SEQ ID NO:4 having at the residue corresponding to X14 a valine" or X14V refers to a reference sequence in which the corresponding residue at X14 in SEQ ID NO:4, which is a tyrosine, has been changed to valine.

"Comparison window" refers to a conceptual segment of at least about 20 contiguous nucleotide positions or amino acids residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

As used herein, "substantial identity" refers to a polynucleotide or polypeptide sequence that has at least 80 percent sequence identity, at least 85 percent identity, at least between 89 to 95 percent sequence identity, or more usually, at least 99 percent sequence identity as compared to a reference sequence over a comparison window of at least 20 residue positions, frequently over a window of at least 30-50 residues, wherein the percentage of sequence identity is calculated by comparing the reference sequence to a sequence that includes deletions or additions which total 20 percent or less of the reference sequence over the window of comparison. In some specific embodiments applied to polypeptides, the term "substantial identity" means that two polypeptide sequences, when optimally aligned, such as by the programs GAP or BESTFIT using default gap weights, share at least 80 percent sequence identity, preferably at least 89 percent sequence identity, at least 95 percent sequence identity or more (e.g., 99 percent sequence identity). In some embodiments, residue positions that are not identical in sequences being compared differ by conservative amino acid substitutions.

"Corresponding to," "reference to," and "relative to" when used in the context of the numbering of a given amino acid or polynucleotide sequence refer to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered TdT, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned.

"Amino acid difference" or "residue difference" or "substitution" refers to a change in the amino acid residue at a position of a polypeptide sequence relative to the amino acid residue at a corresponding position in a reference sequence. The positions of amino acid differences generally are referred to herein as "Xn," where n refers to the corresponding position in the reference sequence upon which the residue difference is based. For example, a "residue difference at position X25 as compared to SEQ ID NO: 2" refers to a change of the amino acid residue at the polypeptide position corresponding to position 25 of SEQ ID NO:2. Thus, if the reference polypeptide of SEQ ID NO: 2 has a valine at position 25, then a "residue difference at position X25 as compared to SEQ ID NO:2" an amino acid substitution of any residue other than valine at the position of the polypeptide corresponding to position 25 of SEQ ID NO: 2. In most instances herein, the specific amino acid residue difference at a position is indicated as "XnY" where "Xn" specified the corresponding position as described above, and "Y" is the single letter identifier of the amino acid found in the engineered polypeptide (i.e., the different residue than in the reference polypeptide). In some embodiments, more than one amino acid can appear in a specified residue position (i.e., the alternative amino acids can be listed in the form XnY/Z, where Y and Z represent alternate amino acid residues). In some instances (e.g., in Tables 7.2, 8.2, 9.2, 10.2, 11.2, 12.2, 13.2, 14.2, 15.2, 16.2, 17.2, 18.2, 19.2, 20.2, 21.2, 22.2, 23.2, 24.2, 25.2, 26.2, 27.2, 28.2, 29.2, 30.2, 31.2, 32.2, 33.2, 34.2, 35.2, 36.2, 37.2, 38.2, 39.2, 40.2, 41.2, 42.2, 43.2, 44.2, 45.2, 46.2, 47.2, 48.2, 49.2, 50.2, 51.2, 52.2, 53.2, 54.2, 55.2, 56.2, 57.2, 58.2, 59.2, 60.2, 61.2, 62.2, 63.2, 64.2, 65.2, 66.2, 74.2, 75.2, 76.2, 77.2, 78.2, 79.2, 80.2, 81.2, 82.2, 83.2, 84.2, 85.2, 86.2, 87.2, 88.2, 89.2, 90.2, 91.2, 92.2, 93.2, 94.2, 95.2, 96.2, 97.2, 98.2, 99.2, 100.2, 101.2, 102.2, 103.2, 104.2, 105.2, 106.2, 107.2, and 108.2) the present invention also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. Furthermore, in some instances, a polypeptide of the present invention can include one or more amino acid residue differences relative to a reference sequence, which is indicated by a list of the specified positions where changes are made relative to the reference sequence. In some additional embodiments, the present invention provides engineered polypeptide sequences comprising both conservative and non-conservative amino acid substitutions.

As used herein, "conservative amino acid substitution" refers to a substitution of a residue with a different residue having a similar side chain, and thus typically involves substitution of the amino acid in the polypeptide with amino acids within the same or similar defined class of amino acids. By way of example and not limitation, an amino acid with an aliphatic side chain is substituted with another aliphatic amino acid (e.g., alanine, valine, leucine, and isoleucine); an amino acid with an hydroxyl side chain is substituted with another amino acid with a hydroxyl side chain (e.g., serine and threonine); an amino acid having aromatic side chains is substituted with another amino acid having an aromatic side chain (e.g., phenylalanine, tyrosine, tryptophan, and histidine); an amino acid with a basic side chain is substituted with another amino acid with a basis side chain (e.g., lysine and arginine); an amino acid with an acidic side chain is substituted with another amino acid with an acidic side chain (e.g., aspartic acid or glutamic acid); and/or a hydrophobic or hydrophilic amino acid is replaced with another hydrophobic or hydrophilic amino acid, respectively. Exemplary conservative substitutions are provided in Table 1 below.

TABLE 1

Conservative Amino Acid Substitution Examples

| Residue | Possible Conservative Substitutions |
|---|---|
| A, L, V, I | Other aliphatic (A, L, V, I)<br>Other non-polar (A, L, V, I, G, M) |
| G, M | Other non-polar (A, L, V, I, G, M) |
| D, E | Other acidic (D, E) |
| K, R | Other basic (K, R) |
| N, Q, S, T | Other polar |
| H, Y, W, F | Other aromatic (H, Y, W, F) |
| C, P | None |

"Non-conservative substitution" refers to substitution of an amino acid in the polypeptide with an amino acid with significantly differing side chain properties. Non-conservative substitutions may use amino acids between, rather than within, the defined groups and affects (a) the structure of the peptide backbone in the area of the substitution (e.g., proline for glycine), (b) the charge or hydrophobicity, or (c) the bulk of the side chain. By way of example and not limitation, an exemplary non-conservative substitution can be an acidic amino acid substituted with a basic or aliphatic amino acid; an aromatic amino acid substituted with a small amino acid; and a hydrophilic amino acid substituted with a hydrophobic amino acid.

"Deletion" refers to modification to the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the reference enzyme while retaining enzymatic activity and/or retaining the improved properties of an engineered TdT enzyme. Deletions can be directed to the internal portions and/or terminal portions of the polypeptide. In various embodiments, the deletion can comprise a continuous segment or can be discontinuous.

"Insertion" refers to modification to the polypeptide by addition of one or more amino acids from the reference polypeptide. In some embodiments, the improved engineered TdT enzymes comprise insertions of one or more amino acids to the naturally occurring polypeptide as well as insertions of one or more amino acids to other improved TdT polypeptides. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

"Fragment" as used herein refers to a polypeptide that has an amino-terminal and/or carboxy-terminal deletion, but where the remaining amino acid sequence is identical to the corresponding positions in the sequence. Fragments can be at least 14 amino acids long, at least 20 amino acids long, at least 50 amino acids long or longer, and up to 70%, 80%, 90%, 95%, 98%, and 99% of the full-length TdT polypeptide, for example the polypeptide of SEQ ID NO: 4 or an TdT provided in the even-numbered sequences of SEQ ID NOs: 6-3592 and 3698-6766.

"Isolated polypeptide" refers to a polypeptide which is substantially separated from other contaminants that naturally accompany it, e.g., protein, lipids, and polynucleotides. The term embraces polypeptides which have been removed or purified from their naturally-occurring environment or expression system (e.g., host cell or in vitro synthesis). The engineered TdT enzymes may be present within a cell, present in the cellular medium, or prepared in various forms, such as lysates or isolated preparations. As such, in some embodiments, the engineered TdT enzyme can be an isolated polypeptide.

"Substantially pure polypeptide" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. Generally, a substantially pure TdT composition will comprise about 60% or more, about 70% or more, about 80% or more, about 90% or more, about 95% or more, and about 98% or more of all macromolecular species by mole or % weight present in the composition. In some embodiments, the object species is purified to essential homogeneity (i.e., contaminant species cannot be detected in the composition by conventional detection methods) wherein the composition consists essentially of a single macromolecular species. Solvent species, small molecules (<500 Daltons), and elemental ion species are not considered macromolecular species. In some embodiments, the isolated engineered TdT polypeptide is a substantially pure polypeptide composition.

As used herein, "improved enzyme property" refers to at least one improved property of an enzyme. In some embodiments, the present invention provides engineered TdT polypeptides that exhibit an improvement in any enzyme property as compared to a reference TdT polypeptide and/or a wild-type TdT polypeptide, and/or another engineered TdT polypeptide. For the engineered TdT polypeptides described herein, the comparison is generally made to the wild-type enzyme from which the TdT is derived, although in some embodiments, the reference enzyme can be another improved engineered TdT. Thus, the level of "improvement" can be determined and compared between various TdT polypeptides, including wild-type, as well as engineered TdTs. Improved properties include, but are not limited, to such properties as enzymatic activity (which can be expressed in terms of percent conversion of the substrate), thermo stability, solvent stability, pH activity profile, cofactor requirements, refractoriness to inhibitors (e.g., substrate or product inhibition), activity at elevated temperatures, increased soluble expression, decreased by-product formation, increased specific activity on NTP-3'-O-RBG substrates, and/or increased activity on various oligo acceptor substrates (including enantioselectivity).

"Increased enzymatic activity" refers to an improved property of the TdT polypeptides, which can be represented by an increase in specific activity (e.g., product produced/time/weight protein) or an increase in percent conversion of the substrate to the product (e.g., percent conversion of starting amount of substrate to product in a specified time period using a specified amount of TdT) as compared to the reference TdT enzyme. Exemplary methods to determine enzyme activity are provided in the Examples. Any property relating to enzyme activity may be affected, including the classical enzyme properties of $K_m$, $V_{max}$ or $k_{cat}$, changes of which can lead to increased enzymatic activity. Improvements in enzyme activity can be from about 1.2 times the enzymatic activity of the corresponding wild-type enzyme, to as much as 2 times, 5 times, 10 times, 20 times, 25 times, 50 times or more enzymatic activity than the naturally occurring or another engineered TdT from which the TdT polypeptides were derived. TdT activity can be measured by any one of standard assays, such as by monitoring changes in properties of substrates, cofactors, or products. In some embodiments, the amount of products generated can be measured by Liquid Chromatography-Mass Spectrometry (LC-MS), HPLC, or other methods, as known in the art. Comparisons of enzyme activities are made using a defined preparation of enzyme, a defined assay under a set condition, and one or more defined substrates, as further described in detail herein. Generally, when lysates are compared, the numbers of cells and the amount of protein assayed are determined as well as use of identical expression systems and identical host cells to minimize variations in amount of enzyme produced by the host cells and present in the lysates.

"Conversion" refers to the enzymatic conversion of the substrate(s) to the corresponding product(s). "Percent conversion" refers to the percent of the substrate that is converted to the product within a period of time under specified conditions. Thus, the "enzymatic activity" or "activity" of a TdT polypeptide can be expressed as "percent conversion" of the substrate to the product.

"Thermostable" refers to a TdT polypeptide that maintains similar activity (more than 60% to 80% for example) after exposure to elevated temperatures (e.g., 40-80° C.) for a period of time (e.g., 0.5-24 hrs) compared to the wild-type enzyme exposed to the same elevated temperature.

"Solvent stable" refers to a TdT polypeptide that maintains similar activity (more than e.g., 60% to 80%) after exposure to varying concentrations (e.g., 5-99%) of solvent (ethanol, isopropyl alcohol, dimethylsulfoxide (DMSO), tetrahydrofuran, 2-methyltetrahydrofuran, acetone, toluene, butyl acetate, methyl tert-butyl ether, etc.) for a period of time (e.g., 0.5-24 hrs) compared to the wild-type enzyme exposed to the same concentration of the same solvent.

"Thermo- and solvent stable" refers to a TdT polypeptide that is both thermostable and solvent stable.

The term "stringent hybridization conditions" is used herein to refer to conditions under which nucleic acid hybrids are stable. As known to those of skill in the art, the stability of hybrids is reflected in the melting temperature ($T_m$) of the hybrids. In general, the stability of a hybrid is a function of ion strength, temperature, G/C content, and the presence of chaotropic agents. The $T_m$ values for polynucleotides can be calculated using known methods for predicting melting temperatures (See e.g., Baldino et al., Meth. Enzymol., 168:761-777 [1989]; Bolton et al., Proc. Natl. Acad. Sci. USA 48:1390 [1962]; Bresslauer et al., Proc. Natl. Acad. Sci. USA 83:8893-8897 [1986]; Freier et al., Proc. Natl. Acad. Sci. USA 83:9373-9377 [1986]; Kierzek et al., Biochem., 25:7840-7846 [1986]; Rychlik et al., 1990, Nucl. Acids Res., 18:6409-6412 [1990](erratum, Nucl. Acids Res., 19:698 [1991]); Sambrook et al., supra); Suggs et al., 1981, in *Developmental Biology Using Purified Genes*, Brown et al. [eds.], pp. 683-693, Academic Press, Cambridge, MA [1981]; and Wetmur, Crit. Rev. Biochem. Mol. Biol., 26:227-259 [1991]). In some embodiments, the polynucleotide encodes the polypeptide disclosed herein and hybridizes under defined conditions, such as moderately stringent or highly stringent conditions, to the complement of a sequence encoding an engineered TdT enzyme of the present invention.

"Hybridization stringency" relates to hybridization conditions, such as washing conditions, in the hybridization of nucleic acids. Generally, hybridization reactions are performed under conditions of lower stringency, followed by washes of varying but higher stringency. The term "moderately stringent hybridization" refers to conditions that permit target-DNA to bind a complementary nucleic acid that has about 60% identity, preferably about 75% identity, about 85% identity to the target DNA, with greater than about 90% identity to target-polynucleotide. Exemplary moderately stringent conditions are conditions equivalent to hybridization in 50% formamide, 5× Denhart's solution, 5×SSPE, 0.2% SDS at 42° C., followed by washing in 0.2×SSPE, 0.2% SDS, at 42° C. "High stringency hybridization" refers generally to conditions that are about 10° C. or less from the thermal melting temperature $T_m$ as determined under the solution condition for a defined polynucleotide sequence. In some embodiments, a high stringency condition refers to conditions that permit hybridization of only those nucleic acid sequences that form stable hybrids in 0.018M NaCl at 65° C. (i.e., if a hybrid is not stable in 0.018M NaCl at 65° C., it will not be stable under high stringency conditions, as contemplated herein). High stringency conditions can be provided, for example, by hybridization in conditions equivalent to 50% formamide, 5× Denhart's solution, 5×SSPE, 0.2% SDS at 42° C., followed by washing in 0.1×SSPE, and 0.1% SDS at 65° C. Another high stringency condition is hybridizing in conditions equivalent to hybridizing in 5×SSC containing 0.1% (w:v) SDS at 65° C. and washing in 0.1×SSC containing 0.1% SDS at 65° C. Other high stringency hybridization conditions, as well as moderately stringent conditions, are described in the references cited above.

"Heterologous" polynucleotide refers to any polynucleotide that is introduced into a host cell by laboratory techniques, and includes polynucleotides that are removed from a host cell, subjected to laboratory manipulation, and then reintroduced into a host cell.

"Codon optimized" refers to changes in the codons of the polynucleotide encoding a protein to those preferentially used in a particular organism such that the encoded protein is efficiently expressed in the organism of interest. Although the genetic code is degenerate in that most amino acids are represented by several codons, called "synonyms" or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome. In some embodiments, the polynucleotides encoding the TdT enzymes may be codon optimized for optimal production from the host organism selected for expression.

As used herein, "preferred, optimal, high codon usage bias codons" refers interchangeably to codons that are used at higher frequency in the protein coding regions than other codons that code for the same amino acid. The preferred codons may be determined in relation to codon usage in a single gene, a set of genes of common function or origin, highly expressed genes, the codon frequency in the aggregate protein coding regions of the whole organism, codon frequency in the aggregate protein coding regions of related organisms, or combinations thereof. Codons whose frequency increases with the level of gene expression are typically optimal codons for expression. A variety of methods are known for determining the codon frequency (e.g., codon usage, relative synonymous codon usage) and codon preference in specific organisms, including multivariate analysis, for example, using cluster analysis or correspondence analysis, and the effective number of codons used in a gene (See e.g., GCG CodonPreference, Genetics Computer Group Wisconsin Package; CodonW, Peden, University of Nottingham; McInerney, Bioinform., 14:372-73 [1998]; Stenico et al., Nucl. Acids Res., 222437-46 [1994]; Wright, Gene 87:23-29 [1990]). Codon usage tables are available for many different organisms (See e.g., Wada et al., Nucl. Acids Res., 20:2111-2118 [1992]; Nakamura et al., Nucl. Acids Res., 28:292 [2000]; Duret, et al., supra; Henaut and Danchin, in *Escherichia coli and Salmonella*, Neidhardt, et al. (eds.), ASM Press, Washington D.C., p. 2047-2066 [1996]). The data source for obtaining codon usage may rely on any available nucleotide sequence capable of coding for a protein. These data sets include nucleic acid sequences actually known to encode expressed proteins (e.g., complete protein coding sequences-CDS), expressed sequence tags (ESTS), or predicted coding regions of genomic sequences (See e.g., Mount, *Bioinformatics: Sequence and Genome Analysis*, Chapter 8, Cold Spring Harbor Laboratory Press, Cold Spring Harbor, N.Y. [2001]; Uberbacher, Meth. Enzymol., 266:259-281 [1996]; and Tiwari et al., Comput. Appl. Biosci., 13:263-270 [1997]).

"Control sequence" is defined herein to include all components, which are necessary or advantageous for the expression of a polynucleotide and/or polypeptide of the present invention. Each control sequence may be native or foreign to the nucleic acid sequence encoding the polypeptide. Such control sequences include, but are not limited to, a leader, polyadenylation sequence, propeptide sequence, promoter, signal peptide sequence, and transcription terminator. At a minimum, the control sequences include a promoter, and transcriptional and translational stop signals. The control sequences may be provided with linkers for the purpose of introducing specific restriction sites facilitating ligation of the control sequences with the coding region of the nucleic acid sequence encoding a polypeptide.

"Operably linked" is defined herein as a configuration in which a control sequence is appropriately placed (i.e., in a functional relationship) at a position relative to a polynucleotide of interest such that the control sequence directs or regulates the expression of the polynucleotide and/or polypeptide of interest.

"Promoter sequence" refers to a nucleic acid sequence that is recognized by a host cell for expression of a polynucleotide of interest, such as a coding sequence. The promoter sequence contains transcriptional control sequences, which mediate the expression of a polynucleotide of interest. The promoter may be any nucleic acid sequence which shows transcriptional activity in the host cell of choice including mutant, truncated, and hybrid promoters, and may be obtained from genes encoding extracellular or intracellular polypeptides either homologous or heterologous to the host cell.

"Suitable reaction conditions" refer to those conditions in the biocatalytic reaction solution (e.g., ranges of enzyme loading, substrate loading, cofactor loading, temperature, pH, buffers, co-solvents, etc.) under which a TdT polypeptide of the present invention is capable of converting one or more substrate compounds to a product compound (e.g., addition of a NTP-3'-O-RBG to an oligo acceptor substrate). Exemplary "suitable reaction conditions" are provided in the present invention and illustrated by the Examples.

"Composition" refers to a mixture or combination of one or more substances, wherein each substance or component of the composition retains its individual properties. As used herein, a biocatalytic composition refers to a combination of one or more substances useful for biocatalysis.

"Loading", such as in "compound loading" or "enzyme loading" or "cofactor loading" refers to the concentration or amount of a component in a reaction mixture at the start of the reaction.

"Substrate" in the context of a biocatalyst mediated process refers to the compound or molecule acted on by the biocatalyst. For example, a TdT biocatalyst used in the synthesis processes disclosed herein acts on a NTP-3'-O-RBG substrate and an oligo acceptor substrate.

"Product" in the context of a biocatalyst mediated process refers to the compound or molecule resulting from the action of the biocatalyst. For example, an exemplary product for a TdT biocatalyst used in a process disclosed herein is an oligo acceptor extension product, as depicted in Schemes 1 and 2.

"Alkyl" refers to saturated hydrocarbon groups of from 1 to 18 carbon atoms inclusively, either straight chained or branched, more preferably from 1 to 8 carbon atoms inclusively, and most preferably 1 to 6 carbon atoms inclusively. An alkyl with a specified number of carbon atoms is denoted in parenthesis (e.g., $(C_1\text{-}C_6)$alkyl refers to an alkyl of 1 to 6 carbon atoms).

"Alkenyl" refers to hydrocarbon groups of from 2 to 12 carbon atoms inclusively, either straight or branched containing at least one double bond but optionally containing more than one double bond.

"Alkynyl" refers to hydrocarbon groups of from 2 to 12 carbon atoms inclusively, either straight or branched containing at least one triple bond but optionally containing more than one triple bond, and additionally optionally containing one or more double bonded moieties.

"Heteroalkyl, "heteroalkenyl," and heteroalkynyl," refer respectively, to alkyl, alkenyl and alkynyl as defined herein in which one or more of the carbon atoms are each independently replaced with the same or different heteroatoms or heteroatomic groups. Heteroatoms and/or heteroatomic groups which can replace the carbon atoms include, but are not limited to —O—, —S—, —S—O—, $—NR^\gamma—$, —PH—, —S(O)—, $—S(O)_2—$, $—S(O)\ NR^\gamma—$, $—S(O)_2\ NR^\gamma$, and the like, including combinations thereof, where each $R^\gamma$ is independently selected from hydrogen, alkyl, cycloalkyl, heterocycloalkyl, aryl, and heteroaryl.

"Amino" refers to the group $—NH_2$. Substituted amino refers to the group $—NHR^\eta$, $NR^\eta R^\eta$, and $NR^\eta R^\eta R^\eta$, where each $R^\eta$ is independently selected from substituted or unsubstituted alkyl, cycloalkyl, cycloheteroalkyl, alkoxy, aryl, heteroaryl, heteroarylalkyl, acyl, alkoxycarbonyl, sulfanyl, sulfinyl, sulfonyl, and the like. Typical amino groups include, but are limited to, dimethylamino, diethylamino, trimethylammonium, triethylammonium, methylysulfonylamino, furanyl-oxy-sulfamino, and the like.

"Aminoalkyl" refers to an alkyl group in which one or more of the hydrogen atoms are replaced with one or more amino groups, including substituted amino groups.

"Aminocarbonyl" refers to $—C(O)NH_2$. Substituted aminocarbonyl refers to $—C(O)NR^\eta R^\eta$, where the amino group $NR^\eta R^\eta$ is as defined herein.

"Oxy" refers to a divalent group —O—, which may have various substituents to form different oxy groups, including ethers and esters.

"Alkoxy" or "alkyloxy" are used interchangeably herein to refer to the group $—OR^\xi$, wherein $R^\xi$ is an alkyl group, including optionally substituted alkyl groups.

"Carboxy" refers to —COOH.

"Carbonyl" refers to —C(O)—, which may have a variety of substituents to form different carbonyl groups including acids, acid halides, aldehydes, amides, esters, and ketones.

"Carboxyalkyl" refers to an alkyl in which one or more of the hydrogen atoms are replaced with one or more carboxy groups.

"Aminocarbonylalkyl" refers to an alkyl substituted with an aminocarbonyl group, as defined herein.

"Halogen" or "halo" refers to fluoro, chloro, bromo and iodo.

"Haloalkyl" refers to an alkyl group in which one or more of the hydrogen atoms are replaced with a halogen. Thus, the term "haloalkyl" is meant to include monohaloalkyls, dihaloalkyls, trihaloalkyls, etc. up to perhaloalkyls. For example, the expression "$(C_1\text{-}C_2)$ haloalkyl" includes 1-fluoromethyl, difluoromethyl, trifluoromethyl, 1-fluoroethyl, 1,1-difluoroethyl, 1,2-difluoroethyl, 1,1,1 trifluoroethyl, perfluoroethyl, etc.

"Hydroxy" refers to —OH.

"Hydroxyalkyl" refers to an alkyl group in which in which one or more of the hydrogen atoms are replaced with one or more hydroxy groups.

"Thiol" or "sulfanyl" refers to —SH. Substituted thiol or sulfanyl refers to $—S—R^\eta$, where $R^\eta$ is an alkyl, aryl or other suitable substituent.

"Sulfonyl" refers to $—SO_2—$. Substituted sulfonyl refers to $—SO_2—R^\eta$, where $R^\eta$ is an alkyl, aryl or other suitable substituent.

"Alkylsulfonyl" refers to $—SO_2—R^\xi$, where $R^\xi$ is an alkyl, which can be optionally substituted. Typical alkylsulfonyl groups include, but are not limited to, methylsulfonyl, ethylsulfonyl, n-propylsulfonyl, and the like.

"Phosphate" as used herein refers to a functional group comprised of an orthophosphate ion (phosphorous atom covalently linked to four oxygen atoms). The orthophosphate ion is commonly found with one or more hydrogen atoms or organic groups.

"Phosphorylated" as used herein refers to the addition or presence of one of more phosphoryl groups (phosphorous atom covalently linked to the three oxygen atoms).

"Optionally substituted" as used herein with respect to the foregoing chemical groups means that positions of the chemical group occupied by hydrogen can be substituted with another atom (unless otherwise specified) exemplified by, but not limited to carbon, oxygen, nitrogen, or sulfur, or a chemical group, exemplified by, but not limited to, hydroxy, oxo, nitro, methoxy, ethoxy, alkoxy, substituted alkoxy, trifluoromethoxy, haloalkoxy, fluoro, chloro, bromo, iodo, halo, methyl, ethyl, propyl, butyl, alkyl, alkenyl, alkynyl, substituted alkyl, trifluoromethyl, haloalkyl, hydroxyalkyl, alkoxyalkyl, thio, alkylthio, acyl, carboxy, alkoxycarbonyl, carboxamido, substituted carboxamido, alkylsulfonyl, alkylsulfinyl, alkylsulfonylamino, sulfonamido, substituted sulfonamido, cyano, amino, substituted amino, alkylamino, dialkylamino, aminoalkyl, acylamino, amidino, amidoximo, hydroxamoyl, phenyl, aryl, substituted aryl, aryloxy, arylalkyl, arylalkenyl, arylalkynyl, pyridyl, imidazolyl, heteroaryl, substituted heteroaryl, heteroaryloxy, heteroarylalkyl, heteroarylalkenyl, heteroarylalkynyl, cyclopropyl, cyclobutyl, cyclopentyl, cyclohexyl, cycloalkyl, cycloalkenyl, cycloalkylalkyl, substituted cycloalkyl, cycloalkyloxy, pyrrolidinyl, piperidinyl, morpholino, heterocycle, (heterocycle)oxy, and (heterocycle) alkyl; where preferred heteroatoms are oxygen, nitrogen, and sulfur. Additionally, where open valences exist on these substitute chemical groups they can be further substituted with alkyl, cycloalkyl, aryl, heteroaryl, and/or heterocycle groups, that where these open valences exist on carbon they can be further substituted by halogen and by oxygen-, nitrogen-, or sulfur-bonded substituents, and where multiple such open valences exist, these groups can be joined to form a ring, either by direct formation of a bond or by formation of bonds to a new heteroatom, preferably oxygen, nitrogen, or sulfur. It is further contemplated that the above substitutions can be made provided that replacing the hydrogen with the substituent does not introduce unacceptable instability to the molecules of the present invention, and is otherwise chemically reasonable. One of ordinary skill in the art would understand that with respect to any chemical group described as optionally substituted, only sterically practical and/or synthetically feasible chemical groups are meant to be included. "Optionally substituted" as used herein refers to all subsequent modifiers in a term or series of chemical groups. For example, in the term "optionally substituted arylalkyl," the "alkyl" portion and the "aryl" portion of the molecule may or may not be substituted, and for the series "optionally substituted alkyl, cycloalkyl, aryl and heteroaryl," the alkyl, cycloalkyl, aryl, and heteroaryl groups, independently of the others, may or may not be substituted.

"Reaction" as used herein refers to a process in which one or more substances or compounds or substrates is converted into one or more different substances, compounds, or processes.

Template-Independent Synthesis by Engineered TdTs

New methods of efficiently synthesizing long, pure strands of DNA and other polynucleotides are necessary to overcome the limitations of existing phosphoramidite chemical synthesis methods in order to enable a range of emerging and existing synthetic biology applications.

The present invention provides novel terminal deoxynucleotidyl transferases that have improved activity in the template-independent synthesis of polynucleotides using 5'-nucleoside triphosphates ("NTPs") modified with a 3'-O-removable blocking group (NTP-3'-O-RBG). The TdTs of the present disclosure have improved thermostability, activity at elevated temperatures, increased soluble expression, decreased by-product formation, increased affinity for NTP-3'-O-RBG substrates, increased affinity for oligo acceptor substrates, increased activity or specific activity on NTP-3'-O-RBG substrates, and/or increased activity or specific activity on various oligo acceptor substrates as compared to a wild-type TdT or other TdTs known to those of skill in the art. The engineered polypeptides of the present disclosure are variants of SEQ ID NO: 2, a predicted splice variant encoded by the genome of species *Empidonax traillil*. These engineered TdTs are capable of template-independent synthesis of oligonucleotides and polynucleotides.

Template independent synthesis of a defined polynucleotide sequence using an engineered TdT is a multistep process. In one embodiment, an oligo acceptor substrate with a 3'-OH allows addition of a defined NTP-3'-O-RBG substrate by an engineered TdT, as depicted in Scheme 1, below.

Scheme 1

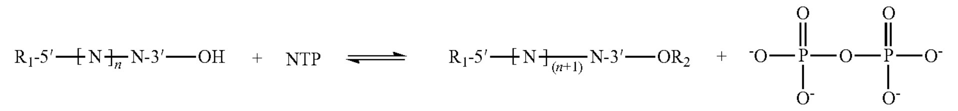

where

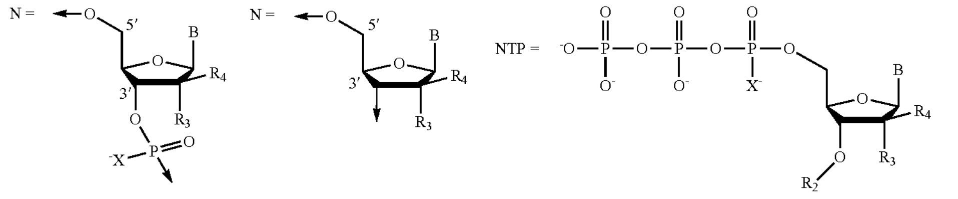

and

B = adenine, guanine, cytidine, thymine, uracil, pseudouridine, 1-methylpseudouridine $R_1$ = H; 6-fluorescein or other fluorescent dyes; alkynyl, thiol, amino, biotin or other linkers
$R_2$ = benzyl, O-nitrobenzyl, benzoyl, acetyl, cyanoethyl, $NH_2$, $NO_2$, $PO_3^{2-}$
$R_3$ = H, OH, OMe, F, Br, Cl, I, Me
$R_4$ = H, OH, OMe, F, Br, Cl, I, Me
X = O, S After addition of the NTP-3'-O-RBG to the 3'-OH of oligo acceptor substrate or the growing polynucleotide chain, the TdT is blocked from further addition by the 3'-O-RBG. The RBG is then removed, exposing the 3'-OH and allowing another round of addition. After each round of addition, the NTP-3'-O-RBG substrate from the previous round is removed and a new NTP-3'-O-RBG substrate is added to sequentially and efficiently create a defined polynucleotide sequence by addition at the 3'-OH end of the polynucleotide or oligo acceptor substrate without a primer sequence.

A variety of oligo acceptor substrates and NTP-3'-O-RBG substrates may be used in this process, as may be envisioned by one of skill in the art. An example of one reaction is detailed in Scheme 2, below. Scheme 2 depicts the TdT-catalyzed reaction of $[N]_7$ATC and 3'-phos-dCTP, as described in Example 15, while other examples of suitable oligo acceptor substrate and NTP-3'-O-RBG pairs are described in other Examples. These examples are non-limiting.

Scheme 2

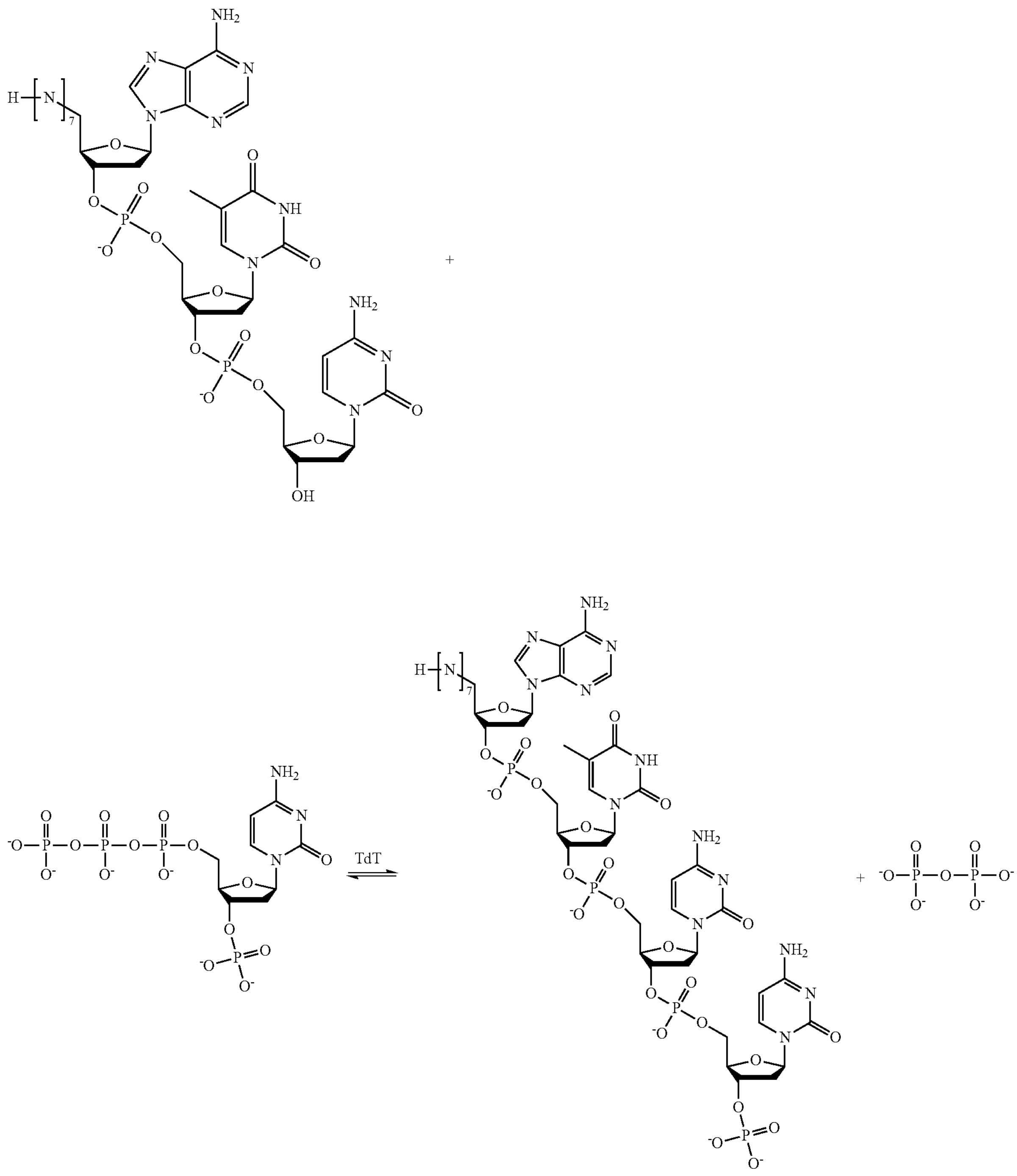

-continued

N =

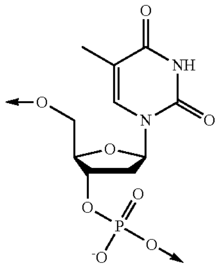

Occasionally, undesired synthesis products are created by the TdT during the addition step. This includes incorporation of NTPs that have lost their blocking group, addition of more than one NTP, or the excision or "back chewing" of the TdT on the growing polynucleotide chain.

In some embodiments, one or more additional quality control steps are used, such as adding an exonuclease prior to removing the blocking group and initiating a new round of synthesis. In some embodiments, a phosphatase is used to breakdown inorganic phosphate and push the reversible TdT reaction toward synthesis.

As described further herein, the engineered TdT polypeptides of the current disclosure exhibit one of more improved properties in the template-independent polynucleotide synthesis process depicted in Scheme 1.

In some embodiments, the present invention provides an engineered TdT polypeptide comprising an amino acid sequence having at least 60% sequence identity to an amino acid reference sequence of SEQ ID NO: 4 and further comprising one or more amino acid residue differences as compared to the reference amino acid sequence, wherein the engineered TdT polypeptide has improved thermostability, increased activity at elevated temperatures, increased soluble expression, decreased by-product formation, increased specific activity on NTP-3'-O-RBG substrates, and/or increased activity on various oligo acceptor substrates as compared to a wild-type TdT or other TdTs known to those of skill in the art.

In particular, the engineered TdTs polypeptides of the present disclosure have been engineered for efficient synthesis of long polynucleotides using NTP-3'-O-RBGs in the process described above.

A variety of suitable reaction conditions are known to those skilled in the art, as detailed below and in the Examples.

Engineered Terminal Deoxynucleotidyl Transferase Polypeptides

The present invention provides engineered terminal deoxynucleotidyl transferase (TDT) polypeptides useful in template-independent polynucleotide synthesis using a nucleoside triphosphate-3'-O-removable blocking group, as well as compositions and methods of utilizing these engineered polypeptides.

The present invention provides TdT polypeptides, polynucleotides encoding the polypeptides, methods of preparing the polypeptides, and methods for using the polypeptides. Where the description relates to polypeptides, it is to be understood that it can describe the polynucleotides encoding the polypeptides.

Suitable reaction conditions under which the above-described improved properties of the engineered polypeptides carry out the desired reaction can be determined with respect to concentrations or amounts of polypeptide, substrate, co-substrate, buffer, solvent, pH, conditions including temperature and reaction time, and/or conditions with the polypeptide immobilized on a solid support, as further described below and in the Examples.

In some embodiments, exemplary engineered TdTs comprise an amino acid sequence that has one or more residue differences as compared to SEQ ID NO: 4 at the residue positions indicated in Tables 7.2, 8.2, 9.2, 10.2, 11.2, 12.2, 13.2, 14.2, 15.2, 16.2, 17.2, 18.2, 19.2, 20.2, 21.2, 22.2, 23.2, 24.2, 25.2, 26.2, 27.2, 28.2, 29.2, 30.2, 31.2, 32.2, 33.2, 34.2, 35.2, 36.2, 37.2, 38.2, 39.2, 40.2, 41.2, 42.2, 43.2, 44.2, 45.2, 46.2, 47.2, 48.2, 49.2, 50.2, 51.2, 52.2, 53.2, 54.2, 55.2, 56.2, 57.2, 58.2, 59.2, 60.2, 61.2, 62.2, 63.2, 64.2, 65.2, 66.2, 74.2, 75.2, 76.2, 77.2, 78.2, 79.2, 80.2, 81.2, 82.2, 83.2, 84.2, 85.2, 86.2, 87.2, 88.2, 89.2, 90.2, 91.2, 92.2, 93.2, 94.2, 95.2, 96.2, 97.2, 98.2, 99.2, 100.2, 101.2, 102.2, 103.2, 104.2, 105.2, 106.2, 107.2, and 108.2.

The structure and function information for the exemplary engineered polypeptides of the present invention are based on the conversion of an oligo acceptor substrate and a NTP-3'-O-RBG or a dideoxy NTP, the results of which are shown below in Tables 7.2, 8.2, 9.2, 10.2, 11.2, 12.2, 13.2, 14.2, 15.2, 16.2, 17.2, 18.2, 19.2, 20.2, 21.2, 22.2, 23.2, 24.2, 25.2, 26.2, 27.2, 28.2, 29.2, 30.2, 31.2, 32.2, 33.2, 34.2, 35.2, 36.2, 37.2, 38.2, 39.2, 40.2, 41.2, 42.2, 43.2, 44.2, 45.2, 46.2, 47.2, 48.2, 49.2, 50.2, 51.2, 52.2, 53.2, 54.2, 55.2, 56.2, 57.2, 58.2, 59.2, 60.2, 61.2, 62.2, 63.2, 64.2, 65.2, 66.2, 74.2, 75.2, 76.2, 77.2, 78.2, 79.2, 80.2, 81.2, 82.2, 83.2, 84.2, 85.2, 86.2, 87.2, 88.2, 89.2, 90.2, 91.2, 92.2, 93.2, 94.2, 95.2, 96.2, 97.2, 98.2, 99.2, 100.2, 101.2, 102.2, 103.2, 104.2, 105.2, 106.2, 107.2, and 108.2, as further described in the Examples. The odd numbered sequence identifiers (i.e., SEQ ID NOs) in these Tables refer to the nucleotide sequence encoding the amino acid sequence provided by the even numbered SEQ ID NOs in these Tables. Exemplary sequences are provided in the electronic sequence listing file accompanying this invention, which is hereby incorporated by reference herein. The amino acid residue differences are based on comparison to the reference sequence of SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636, as indicated.

Terminal deoxynucleotidyl transferase, a member of the Pol X family, has been identified in many species. Members of the diverse Pol X family are known to share certain residues, which are conserved across family members. TdT also has a high level of conservation across species for residues thought to be involved in binding divalent metal ions, ternary complex formation, and binding dNTP and DNA ligands (Dominguez et al. (2000). EMBO, 19(7), 1731-1742.) Additionally, TdTs are known to have splice variants which are N-terminal truncations, lacking a BRCT domain.

Figure 2:
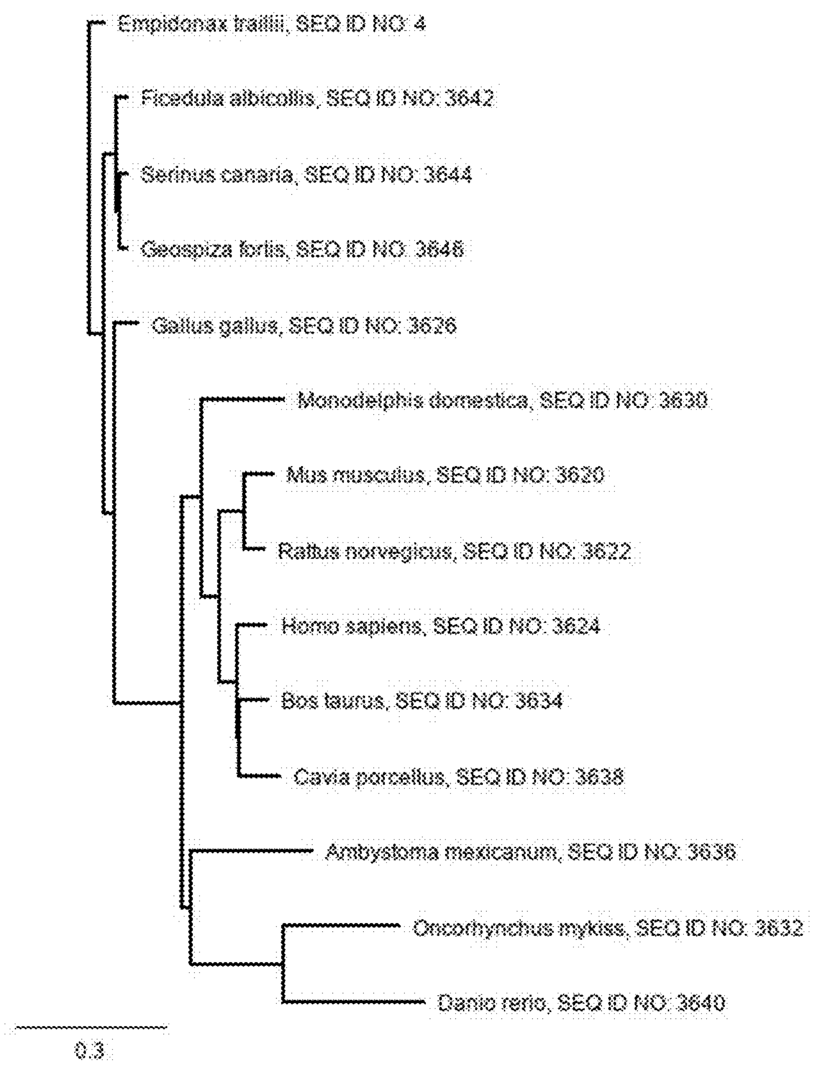
FIG. 2 depicts the truncated TdT variants and the relationships of the enzymes based on sequence conservation as a phylogenetic tree.
Figure 3A:
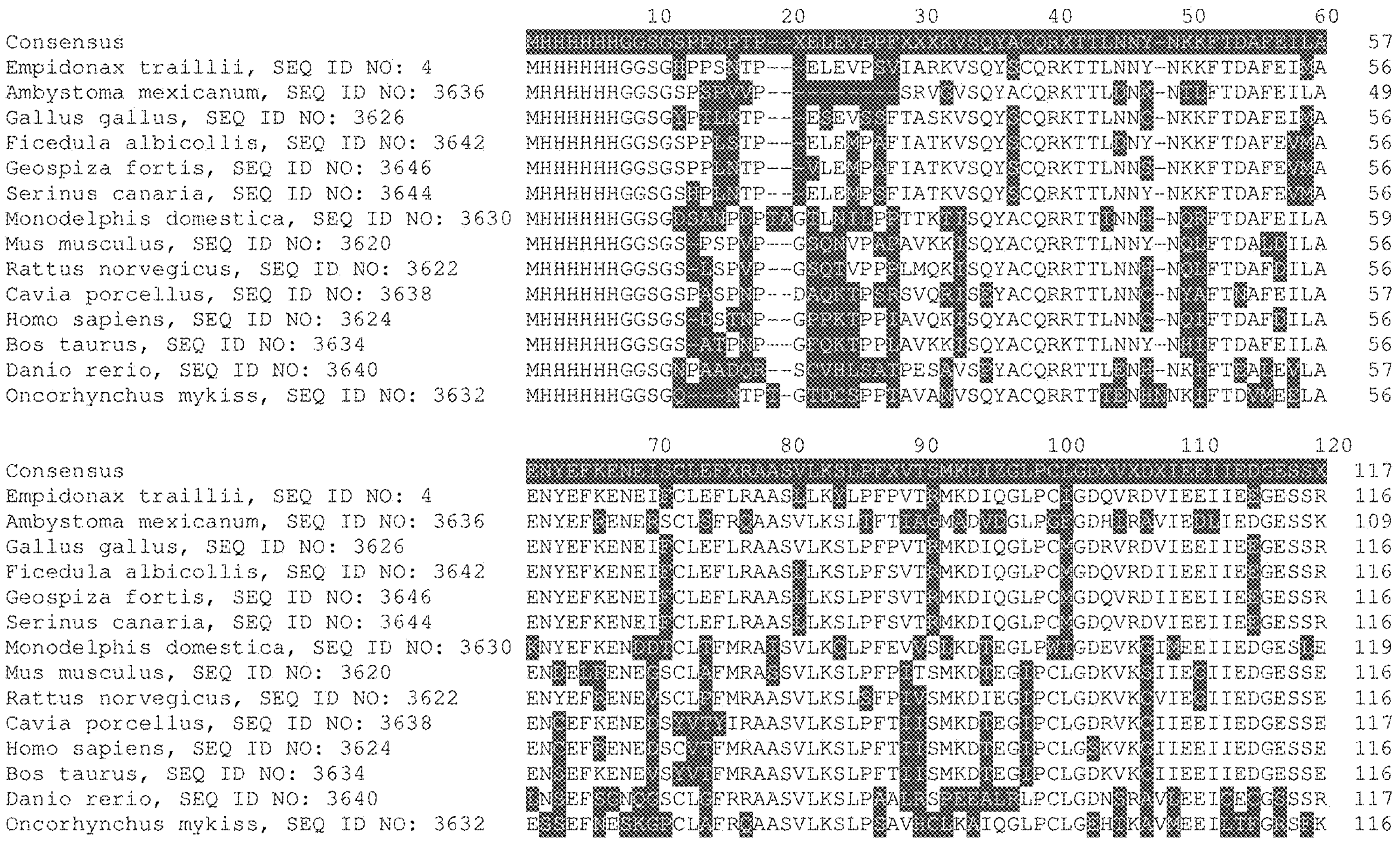
FIGS. 3A, 3B, 3C, and 3D depict an alignment of the TdT variants, highlighting conserved residues.
Figure 3B:
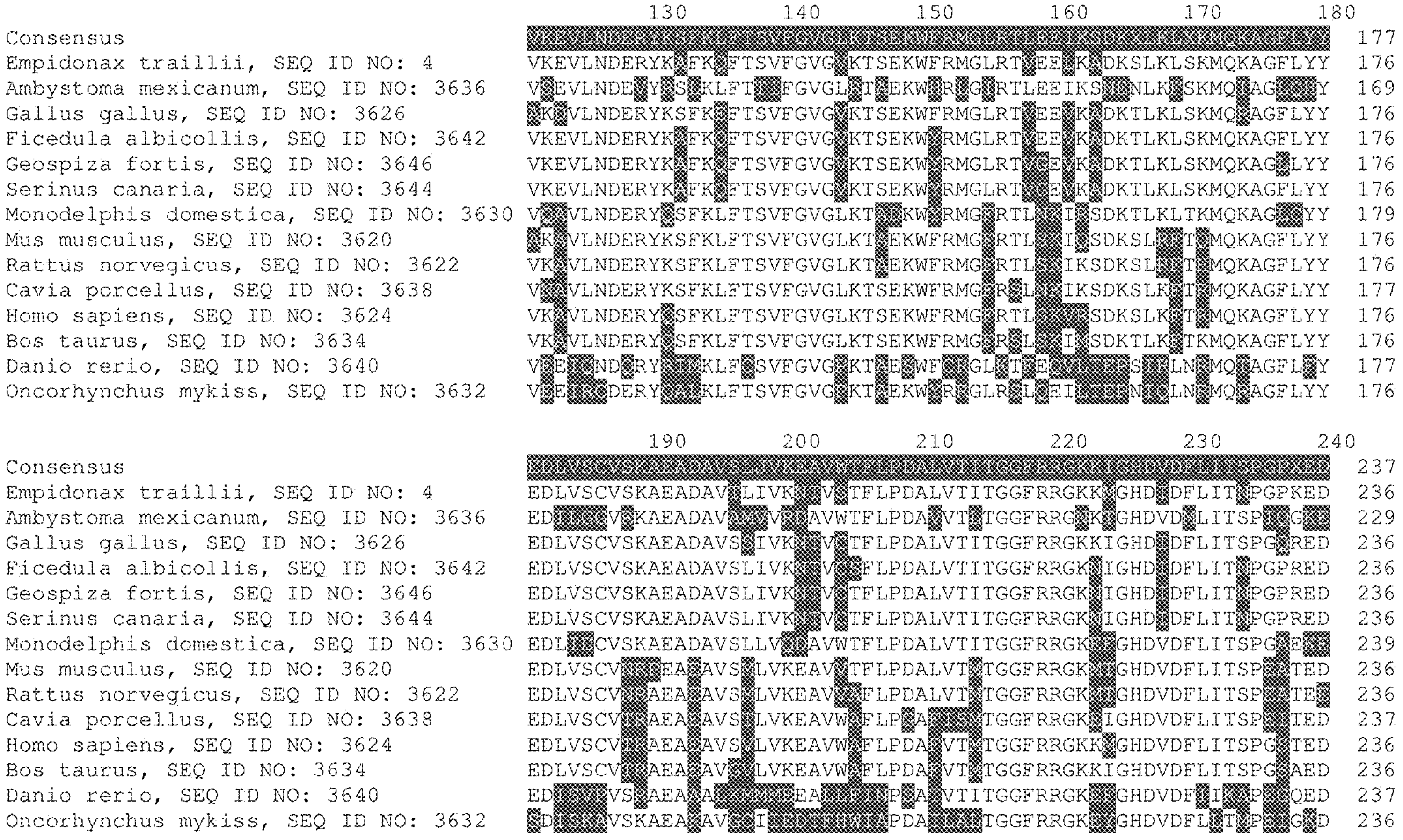
Figure 3C:
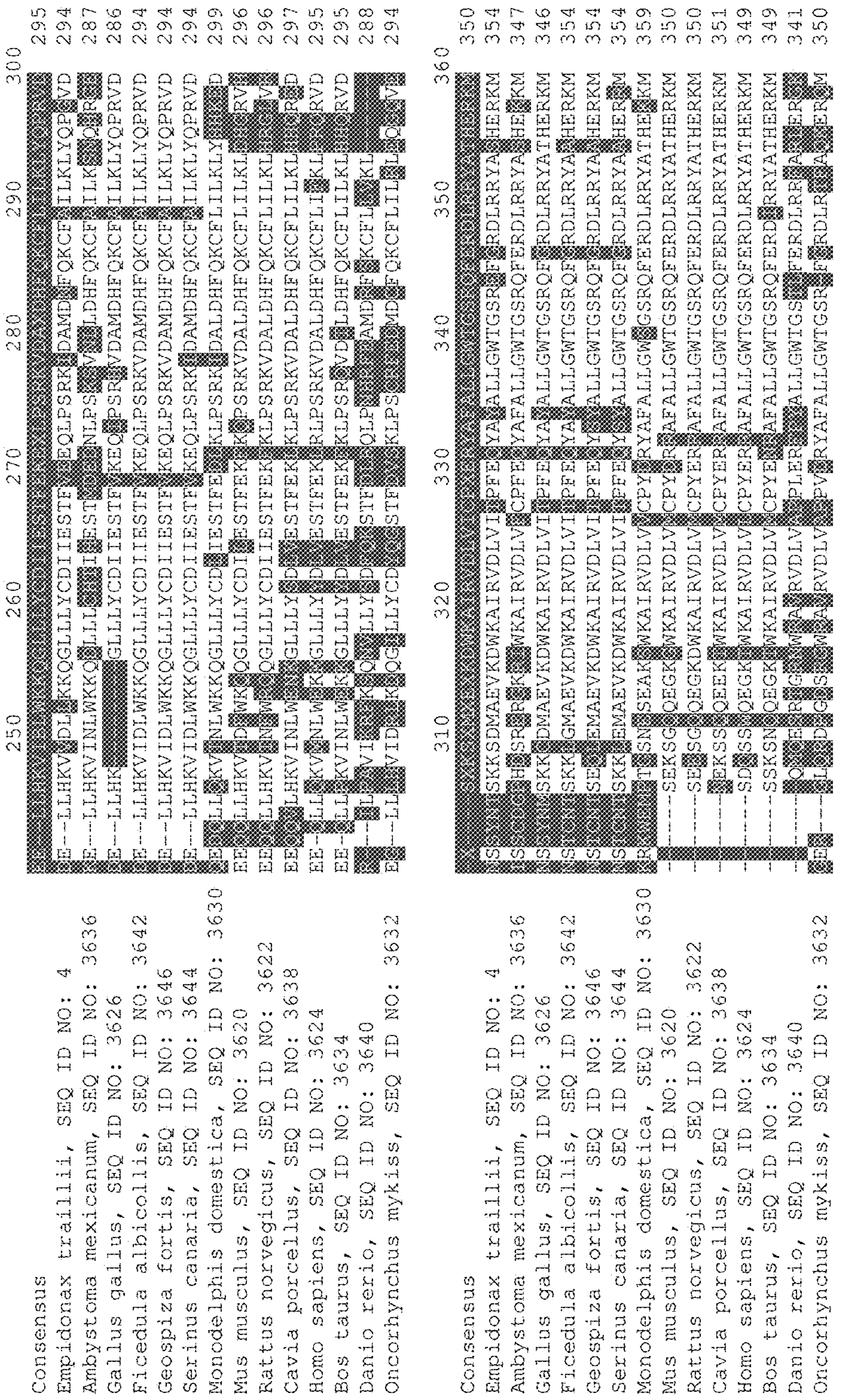
Figure 3D:
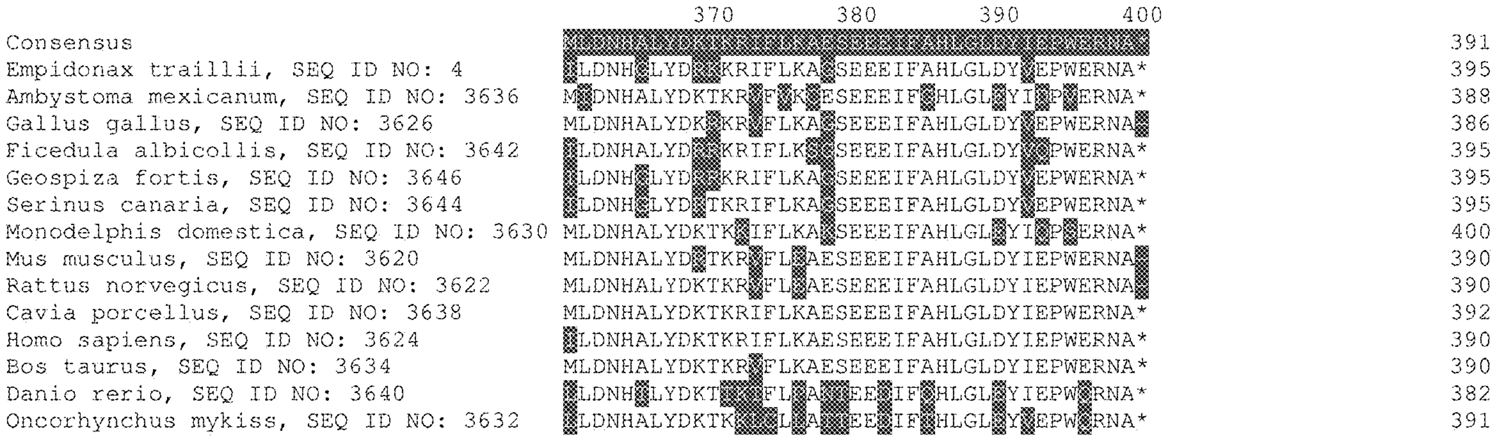

In the present disclosure, TdTs from a variety of species, including both truncated and full-length enzymes, were screened for soluble expression, as described below in Example, 72. FIG. 1 depicts the full-length TdT variants and the relationships of the enzymes based on sequence conservation as a phylogenetic tree. FIG. 2 depicts the truncated TdT variants and the relationships of the enzymes based on sequence conservation as a phylogenetic tree. FIGS. 3A, 3B, 3C, and 3D depict an alignment of TdTs from a variety of species screened for soluble expression in the present disclosure, highlighting conserved residues between these species.

Based on this screen, a predicted splice variant of the wild-type TdT from *Empidonax traillil* (SEQ ID NO: 2) was selected based on soluble expression. The TdT polypeptides of the present disclosure are engineered variants of SEQ ID NO: 2 and SEQ ID NO: 4, which is N-terminal 6-histidine tagged version of the WT TdT truncated at amino acid position 131 (SEQ ID NO:4).

The polypeptides of the present disclosure have residue differences that result in improved properties necessary to develop an efficient TdT enzyme, capable of template-independent synthesis of long polynucleotides. Various residue differences, at both conserved and non-conserved positions, have been discovered to be related to improvements in various enzymes properties, including improved thermostability, increased activity at elevated temperatures, increased soluble expression, decreased by-product formation, increased specific activity on NTP-3'-O-RBG substrates, and/or increased activity on various oligo acceptor substrates as compared to a wild-type TdT or other TdTs known to those of skill in the art.

The activity of each engineered TdT relative to the reference polypeptide of SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636 was determined as conversion of the substrates described in the Examples herein. In some embodiments, a shake flask purified enzyme (SFP) is used as a secondary screen to assess the properties of the engineered TdTs, the results of which are provided in the Examples.

In some embodiments, the specific enzyme properties are associated with the residues differences as compared to SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636 at the residue positions indicated herein. In some embodiments, residue differences affecting polypeptide expression can be used to increase expression of the engineered TdTs.

In light of the guidance provided herein, it is further contemplated that any of the exemplary engineered polypeptides comprising the even-numbered sequences of SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636 find use as the starting amino acid sequence for synthesizing other TdT polypeptides, for example by subsequent rounds of evolution that incorporate new combinations of various amino acid differences from other polypeptides in Tables 7.2, 8.2, 9.2, 10.2, 11.2, 12.2, 13.2, 14.2, 15.2, 16.2, 17.2, 18.2, 19.2, 20.2, 21.2, 22.2, 23.2, 24.2, 25.2, 26.2, 27.2, 28.2, 29.2, 30.2, 31.2, 32.2, 33.2, 34.2, 35.2, 36.2, 37.2, 38.2, 39.2, 40.2, 41.2, 42.2, 43.2, 44.2, 45.2, 46.2, 47.2, 48.2, 49.2, 50.2, 51.2, 52.2, 53.2, 54.2, 55.2, 56.2, 57.2, 58.2, 59.2, 60.2, 61.2, 62.2, 63.2, 64.2, 65.2, 66.2, 74.2, 75.2, 76.2, 77.2, 78.2, 79.2, 80.2, 81.2, 82.2, 83.2, 84.2, 85.2, 86.2, 87.2, 88.2, 89.2, 90.2, 91.2, 92.2, 93.2, 94.2, 95.2, 96.2, 97.2, 98.2, 99.2, 100.2, 101.2, 102.2, 103.2, 104.2, 105.2, 106.2, 107.2, and 108.2, and other residue positions described herein. Further improvements may be generated by including amino acid differences at residue positions that had been maintained as unchanged throughout earlier rounds of evolution.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4 and one or more residue differences or residue difference sets as compared to SEQ ID NO: 4, selected from: 14, 17, 19, 20, 21, 22, 24, 27, 28/304, 55, 66, 67, 68, 80, 99, 103, 111, 113, 115, 140, 158, 159, 160, 161, 167, 170, 180, 192, 197, 200, 201, 219, 233, 235, 238, 246, 249, 256, 258, 267, 268, 273, 295, 296, 297, 300, 303, 304, 306, 322, 350, 353, 367, and 373. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4 and one or more residue differences or residue difference sets as compared to SEQ ID NO: 4, selected from: 14G, 17R, 19S, 20F, 20G, 20S, 21G, 22D, 24E, 24Q, 24V, 27G, 27Y, 28S/304L, 55I, 66A, 66E, 66L, 66R, 67K, 67R, 68R, 80S, 99S, 103R, 103S, 111R, 113Q, 115R, 140I, 158R, 159L, 160S, 161S, 167E, 170Q, 180A, 180T, 192S, 197G, 200A, 200R, 201R, 219A, 219R, 219W, 233G, 233R, 235D, 235S, 235V, 238G, 246G, 249T, 256G, 258C, 267G, 268E, 273R, 295D, 295S, 295V, 295W, 296V, 297A, 297L, 297V, 300S, 303G, 304E, 304W, 306L, 322V, 350V, 353N, 367C, and 373D. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4 and one or more residue differences or residue difference sets as compared to SEQ ID NO: 4, selected from: P14G, T17R, E19S, L20F, L20G, L20S, E21G, V22D, S24E, S24Q, S24V, A27G, A27Y, R28S/S304L, M55I, 166A, 166E, I66L, I66R, F67K, F67R, C68R, Y80S, D99S, D103R, D103S, E111R, E113Q, S115R, V140I, K158R, A159L, D160S, K161S, K167E, K170Q, V180A, V180T, T192S, N197G, S200A, S200R, T201R, K219A, K219R, K219W, P233G, P233R, E235D, E235S, E235V, E238G, L246G, K249T, C256G, I258C, Q267G, L268E, I273R, N295D, N295S, N295V, N295W, S296V, S297A, S297L, S297V, T300S, K303G, S304E, S304W, M306L, T322V, H350V, K353N, R367C, and G373D.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4 and one or more residue differences or residue difference sets as compared to SEQ ID NO: 4, selected from: 10, 17, 20, 27, 28, 55, 62, 63, 66, 67, 68, 68/118, 87, 103, 106, 111, 131, 155, 157, 160, 160/296, 177, 181, 200, 219, 246, 256, 263, 292, 295, 296, 297, 315, and 373. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4 and one or more residue differences or residue difference sets as compared to SEQ ID NO: 4, selected from: 10Q, 17D, 20S, 27G, 28F, 28S, 55L, 62M, 63G, 66V, 67A, 67D, 67N, 68R, 68R/118H, 87S, 103H, 106R, 111T, 131E, 155S, 157A, 157I, 160C, 160N/296W, 160T, 177S, 181R, 200A, 219P, 246C, 256E, 263A, 292S, 295V, 296G, 297T, 315G, 315V, 373D, and 373R. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4 and one or more residue differences or residue difference sets as compared to SEQ ID NO: 4, selected from: S10Q, T17D, L20S, A27G, R28F, R28S, M55L, K62M, E63G, I66V, F67A, F67D, F67N, C68R, C68R/K118H, R87S, D103H, E106R, E111T, Q131E, E155S, L157A, L157I, D160C, D160N/S296W, D160T, E177S, S181R, S200A, K219P, L246C, C256E, F263A, G292S, N295V, S296G, S297T, I315G, I315V, G373D, and G373R.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4 and one or more residue differences or residue difference sets as compared to SEQ ID NO: 4, selected from: 8, 10, 11, 15, 16, 20, 21, 22, 24, 26, 28, 30, 34, 42, 44, 47, 48, 52, 54, 55, 62, 63, 66, 67, 68, 72, 77, 80, 84, 87, 89, 91, 92, 99, 101, 102, 103, 106, 109, 111, 111/346, 113, 115, 116, 118, 122, 123, 131, 140, 144, 147, 156, 157, 160, 160/296, 161, 162, 163, 164, 170, 173, 174, 175, 180, 181, 185, 189, 192, 193, 194, 197, 198, 198/289, 200, 201, 207, 219, 230, 234, 235, 237, 238, 241, 245, 246, 249, 256, 257, 258, 262, 263, 264, 267, 268, 272, 273, 280, 284, 286, 289, 290, 291, 292, 295, 296, 297, 299, 300, 302, 304, 307, 308, 310, 311, 321, 322, 325, 350, 353, 355, 365, 366, 368, 371, 373, and 388. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4 and one or more residue differences or residue difference sets as compared to SEQ ID NO: 4, selected from: 8P, 8R, 10D, 10G, 10Q, 11R, 15F, 15G, 16V, 20G, 21G, 22G, 24N, 24T, 24Y, 26L, 28S, 30G, 30P, 34H, 42T, 44D, 47I, 48N, 52L, 54L, 55L, 62L, 62M, 63G, 66A, 66E, 66R, 66V, 67A, 67D, 67G, 67K, 67N, 67R, 68R, 68S, 68T, 72D, 77V, 80C, 80G, 80R, 80S, 80T, 84T, 87S, 89A, 91L, 92D, 92M, 92S, 99P, 101T, 102W, 103A, 103E, 103L, 103Q, 103S, 106R, 109C, 109L, 111A, 111I, 111M, 111P/346H, 111R, 111S, 111T, 113C, 115E, 115R, 116I, 116P, 118M, 122S, 123G, 131L, 140I, 144R, 147L, 147S, 147Y, 156F, 157A, 157I, 157V, 160C, 160N/296W, 160T, 161L, 161R, 162R, 163R, 164D, 164R, 170D, 173L, 174R, 175D, 180A, 180R, 180T, 181R, 185R, 189A, 192Y, 193A, 193G, 193W, 194K, 197S, 198G, 198G/289H, 200C, 200N, 201L, 201N, 207G, 219G, 219P, 230C, 234L, 235D, 235Q, 235S, 237R, 238L, 238S, 238Y, 241D, 245E, 246C, 246V, 249Q, 256E, 256G, 256P, 257F, 258S, 262G, 262R, 263A, 263K, 264T, 264Y, 267D, 267S, 267V, 267W, 268V, 272G, 273P, 273Q, 280C, 284F, 286A, 289G, 289R, 290K, 290R, 291K, 291Q, 292S, 292V, 295A, 296R, 296W, 296Y, 297P, 297T, 299V, 300L, 300R, 300S, 302A, 304A, 304K, 307I, 308M, 310G, 311V, 321E, 321G, 322R, 322V, 325L, 350E, 350V, 350Y, 353A, 353F, 353N, 355E, 355F, 365D, 365R, 366P, 368L, 371I, 373N, and 388Q. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4 and one or more residue differences or residue difference sets as compared to SEQ ID NO: 4, selected from: G8P, G8R, S10D, S10G, S10Q, G11R, S15F, S15G, N16V, L20G, E21G, V22G, S24N, S24T, S24Y, I26L, R28S, V30G, V30P, S34H, N42T, Y44D, K47I, F48N, F52L, I54L, M55L, K62L, K62M, E63G, I66A, 166E, I66R, I66V, F67A, F67D, F67G, F67K, F67N, F67R, C68R, C68S, C68T, L72D, L77V, Y80C, Y80G, Y80R, Y80S, Y80T, P84T, R87S, K89A, I91L, Q92D, Q92M, Q92S, D99P, V101T, R102W, D103A, D103E, D103L, D103Q, D103S, E106R, I109C, I109L, E111A, E111, E111M, E111P/R346H, E111R, E111S, E111T, E113C, S115E, S115R, R116I, R116P, K118M, N122S, D123G, Q131L, V140I, E144R, F147L, F147S, F147Y, E156F, L157A, L157I, L157V, D160C, D160N/S296W, D160T, K161L, K161R, S162R, L163R, K164D, K164R, K170D, F173L, L174R, Y175D, V180A, V180R, V180T, S181R, K185R, D189A, T192Y, L193A, L193G, L193W, I194K, N197S, T198G, T198G/Y289H, 5200C, S200N, T201L, T201N, L207G, K219G, K219P, N230C, K234L, E235D, E235Q, E235S, D237R, E238L, E238S, E238Y, H241D, D245E, L246C, L246V, K249Q, C256E, C256G, C256P, D257F, I258S, T262G, T262R, F263A, F263K, V264T, V264Y, Q267D, Q267S, Q267V, Q267W, L268V, K272G, I273P, I273Q, Q280C, A284F, L286A, Y289G, Y289R, Q290K, Q290R, P291K, P291Q, G292S, G292V, N295A, S296R, S296W, S296Y, S297P, S297T, N299V, T300L, T300R, T300S, K302A, S304A, S304K, A307I, E308M, K310G, D311V, I321E, I321G, T322R, T322V, E325L, H350E, H350V, H350Y, K353A, K353F, K353N, I355E, I355F, K365D, K365R, K366P, I368L, K371I, G373N, and E388Q.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4 and one or more residue differences or residue difference sets as compared to SEQ ID NO: 4, selected from: 60, 60/259, 60/278, and 65/259. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4 and one or more residue differences or residue difference sets as compared to SEQ ID NO: 4, selected from: 60K, 60K/259K, 60K/278H, and 65K/259Q. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4 and one or more residue differences or residue difference sets as compared to SEQ ID NO: 4, selected from: E60K, E60K/I259K, E60K/N278H, and E65K/1259Q.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4 and one or more residue differences or residue difference sets as compared to SEQ ID NO: 4, selected from: 20, 20/21/68/103/200/238/297, 20/21/68/111/235, 20/21/68/160, 20/21/68/160/180/200/246, 20/21/68/160/246, 20/21/68/180, 20/21/68/180/235, 20/21/68/200/235/297, 20/21/68/233/246/297, 20/21/103/233, 20/21/111, 20/21/111/160/200, 20/21/111/200/238, 20/21/180/297, 20/21/233, 20/68/103/160/200, 20/68/103/180/200, 20/68/160, 20/68/160/180, 20/68/160/

180/233/235/246, 20/68/160/235/297, 20/68/160/246, 20/68/200/238/246, 20/68/235/297, 20/103/160/180/200/235, 20/103/233, 20/111, 20/111/180/235/246/297, 21, 21/68, 21/68/103/111, 21/68/111/200, 21/68/160/180/200/205/297, 21/68/160/180/200/297, 21/68/160/238, 21/68/160/238/246, 21/68/180, 21/68/180/235, 21/68/180/246, 21/68/200, 21/68/235, 21/103/233, 21/233/297, 68, 68/103/160/235, 68/103/200/235/246/297, 68/111/200/238, 68/111/233/236/297, 68/160/233/246, 68/200/235/297, 103, 103/160/180, 103/160/297, 103/233, 111, and 111/160/233/235/297. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4 and one or more residue differences or residue difference sets as compared to SEQ ID NO: 4, selected from: 20G/21G/68R/103S/200R/238G/297A, 20G/21G/68R/160S/180A/200R/246G, 20G/21G/68R/180A, 20G/21G/68R/180A/235S, 20G/21G/111R/160S/200A, 20G/21G/180A/297A, 20G/21G/233G, 20G/68R/103S/160S/200R, 20G/68R/160S, 20S, 20S/21G/68R/111R/235S, 20S/21G/68R/160S, 20S/21G/68R/160S/246G, 20S/21G/68R/200R/235S/297A, 20S/21G/68R/233G/246G/297A, 20S/21G/103S/233G, 20S/21G/111R, 20S/21G/111R/200R/238G, 20S/68R/103S/180A/200A, 20S/68R/160S/180A, 20S/68R/160S/180A/233G/235S/246G, 20S/68R/160S/235S/297A, 20S/68R/160S/246G, 20S/68R/200A/238G/246G, 20S/68R/235S/297A, 20S/103S/160S/180A/200R/235S, 20S/103S/233G, 20S/111R, 20S/111R/180A/235S/246G/297A, 21G, 21G/68R, 21G/68R/103S/111R, 21G/68R/111R/200R, 21G/68R/160S/180A/200R/205A/297A, 21G/68R/160S/180A/200R/297A, 21G/68R/160S/238G, 21G/68R/160S/238G/246G, 21G/68R/180A, 21G/68R/180A/235S, 21G/68R/180A/246G, 21G/68R/200R, 21G/68R/235S, 21G/103S/233G, 21G/233G/297A, 68R, 68R/103S/160S/235S, 68R/103S/200R/235S/246G/297A, 68R/111R/200A/238G, 68R/111R/233G/236N/297A, 68R/160S/233G/246G, 68R/200A/235S/297A, 103S, 103S/160S/180A, 103S/160S/297A, 103S/233G, 111R, and 111R/160S/233G/235S/297A. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4 and one or more residue differences or residue difference sets as compared to SEQ ID NO: 4, selected from: L20G/E21G/C68R/D103S/S200R/E238G/S297A, L20G/E21G/C68R/D160S/V180A/S200R/L246G, L20G/E21G/C68R/V180A, L20G/E21G/C68R/V180A/E235S, L20G/E21G/E111R/D160S/S200A, L20G/E21G/V180A/S297A, L20G/E21G/P233G, L20G/C68R/D103S/D160S/S200R, L20G/C68R/D160S, L20S, L20S/E21G/C68R/E111R/E235S, L20S/E21G/C68R/D160S, L20S/E21G/C68R/D160S/L246G, L20S/E21G/C68R/S200R/E235S/S297A, L20S/E21G/C68R/P233G/L246G/S297A, L20S/E21G/D103S/P233G, L20S/E21G/E111R, L20S/E21G/E111R/S200R/E238G, L20S/C68R/D103S/V180A/S200A, L20S/C68R/D160S/V180A, L20S/C68R/D160S/V180A/P233G/E235S/L246G, L20S/C68R/D160S/E235S/S297A, L20S/C68R/D160S/L246G, L20S/C68R/S200A/E238G/L246G, L20S/C68R/E235S/S297A, L20S/D103S/D160S/V180A/S200R/E235S, L20S/D103S/P233G, L20S/E111R, L20S/E111R/V180A/E235S/L246G/S297A, E21G, E21G/C68R, E21G/C68R/D103S/E111R, E21G/C68R/E111R/S200R, E21G/C68R/D160S/V180A/S200R/D205A/S297A, E21G/C68R/D160S/V180A/S200R/S297A, E21G/C68R/D160S/E238G, E21G/C68R/D160S/E238G/L246G, E21G/C68R/V180A, E21G/C68R/V180A/E235S, E21G/C68R/V180A/L246G, E21G/C68R/S200R, E21G/C68R/E235S, E21G/D103S/P233G, E21G/P233G/S297A, C68R, C68R/D103S/D160S/E235S, C68R/D103S/S200R/E235S/L246G/S297A, C68R/E111R/S200A/E238G, C68R/E111R/P233G/D236N/S297A, C68R/D160S/P233G/L246G, C68R/S200A/E235S/S297A, D103S, D103S/D160S/V180A, D103S/D160S/S297A, D103S/P233G, E111R, and E111R/D160S/P233G/E235S/S297A.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 580 and one or more residue differences or residue difference sets as compared to SEQ ID NO: 580, selected from: 55, 55/67, 55/67/87, 55/67/87/106/111/315, 55/67/87/157/315, 55/67/106/111/157, 55/67/106/315, 55/67/111, 55/67/111/315, 55/67/315, 55/87, 55/87/106, 55/87/106/111/315, 55/87/106/315, 55/87/157, 55/87/157/207, 55/106/111, 55/106/157, 55/111, 55/111/315, 55/157, 55/315, 67, 67/87, 67/87/106/157, 67/87/111/157/315, 67/87/157, 67/87/315, 67/106, 67/106/111, 67/106/111/315, 67/106/157, 67/111, 67/111/315, 67/157, 67/157/315, 87, 87/106, 87/106/111/315, 87/111/157/315, 87/157, 87/157/315, 87/315, 106, 106/111/157, 106/315, 157, 157/315, and 315. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 580 and one or more residue differences or residue difference sets as compared to SEQ ID NO: 580, selected from: 55L, 55L/67A/106R/111T/157I, 55L/67A/111T, 55L/67A/111T/315V, 55L/67D, 55L/67D/87S/157I/315V, 55L/67D/315V, 55L/67M/875, 55L/67M/106R/315V, 55L/67N/875, 55L/67N/87S/106R/111T/315V, 55L/875, 55L/87S/106R, 55L/87S/106R/111T/315V, 55L/87S/106R/315V, 55L/87S/157A, 55L/87S/157I, 55L/87S/157I/207Q, 55L/106R/111T, 55L/106R/157I, 55L/111T, 55L/111T/315V, 55L/157I, 55L/315V, 67A, 67A/87S/106R/157A, 67A/87S/111T/157A/315V, 67A/106R/111T/315V, 67A/111T, 67A/157I, 67D, 67D/111T, 67M, 67M/87S, 67M/87S/157A, 67M/87S/157I, 67M/106R/157A, 67M/111T/315V, 67M/157A, 67M/157A/315V, 67N, 67N/87S, 67N/87S/315V, 67N/106R, 67N/106R/111T, 87S, 87S/106R, 87S/106R/111T/315V, 87S/111T/157A/315V, 87S/111T/157I/315V, 87S/157A, 87S/157I, 87S/157I/315V, 87S/315V, 106R, 106R/111T/157I, 106R/315V, 157A, 157I, 157I/315V, and 315V. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 580 and one or more residue differences or residue difference sets as compared to SEQ ID NO: 580, selected from: M55L, M55L/F67A/E106R/E111T/L157I, M55L/F67A/E111T, M55L/F67A/E111T/I315V, M55L/F67D, M55L/F67D/R87S/L157I/I315V, M55L/F67D/I315V, M55L/F67M/R87S, M55L/F67M/E106R/I315V, M55L/F67N/R87S, M55L/F67N/R87S/E106R/E111T/I315V, M55L/R87S, M55L/R87S/E106R, M55L/R87S/E106R/E111T/I315V, M55L/R87S/E106R/I315V, M55L/R87S/L157A, M55L/R87S/L157I, M55L/R87S/L157I/L207Q, M55L/E106R/E111T, M55L/E106R/L157I, M55L/E111T, M55L/E111T/I315V, M55L/L157I, M55L/I315V, F67A, F67A/R87S/E106R/L157A, F67A/R87S/E111T/L157A/I315V, F67A/E106R/E111T/I315V, F67A/E111T, F67A/L157I, F67D, F67D/E111T, F67M, F67M/R87S, F67M/R87S/L157A, F67M/R87S/L157I, F67M/E106R/L157A, F67M/E111T/I315V, F67M/L157A, F67M/L157A/I315V, F67N, F67N/R87S, F67N/R87S/I315V, F67N/E106R, F67N/E106R/E111T, R87S, R87S/E106R, R87S/E106R/E111T/I315V, R87S/E111T/L157A/I315V, R87S/E111T/L157I/I315V, R87S/L157A, R87S/L157I, R87S/L157I/I315V, R87S/I1315V, E106R, E106R/E111T/L157I, E106R/I315V, L157A, L157I, L157I/I315V, and I315V.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 580 and one or more residue differences or residue difference sets as compared to SEQ ID NO: 580, selected from: 59/62/63/68, 59/62/63/68/103/234, 59/62/63/68/147, 60/62/68/91/111/234/289, 62/63/68, 62/63/68/91/109/210, 62/63/68/91/147/205/210/234, 62/68/91/111/289, 62/68/103, 62/68/111, 91, 91/109/111, 91/109/147/205/210/234, 109/111/205/210/234/289, 111, and 147/210/234. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 580 and one or more residue differences or residue difference sets as compared to SEQ ID NO: 580, selected from: 59A/62N/63G/68C, 59A/62N/63G/68C/103R/234G, 59A/62N/63G/68C/147Y, 60V/62N/68C/91L/111Y/234G/289P, 62N/63G/68C, 62N/63G/68C/91L/109L/210L, 62N/63G/68C/91L/147Y/205G/210L/234G, 62N/68C/91L/111Y/289P, 62N/68C/103R, 62N/68C/111Y, 91L, 91L/109L/I 11Y, 91L/109L/147Y/205G/210L/234G, 109L/111Y/205G/210L/234G/289P, 111Y, and 147Y/210L/234G. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 580 and one or more residue differences or residue difference sets as compared to SEQ ID NO: 580, selected from: Y59A/K62N/E63G/R68C, Y59A/K62N/E63G/R68C/D103R/K234G, Y59A/K62N/E63G/R68C/F147Y, E60V/K62N/R68C/191L/E111Y/K234G/Y289P, K62N/E63G/R68C, K62N/E63G/R68C/I91L/I109L/I210L, K62N/E63G/R68C/I91L/F147Y/D205G/I210L/K234G, K62N/R68C/191L/E111Y/Y289P, K62N/R68C/D103R, K62N/R68C/E111Y, 191L, 191L/I109L/E111Y, 191L/I109L/F147Y/D205G/I210L/K234G, I109L/E111Y/D205G/I210L/K234G/Y289P, E111Y, and F147Y/I210L/K234G.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 692 and one or more residue differences or residue difference sets as compared to SEQ ID NO: 692, selected from: 52/55/106/256, 52/55/181/235/256, 52/55/181/256, 52/99/181/235, 52/106/181/235/256, 52/106/235/256, 52/106/256, 52/173/235, 52/235, 52/235/256, 55/99/181/256, 55/99/256/350, 55/181/235/256/350, 55/256, 99/235, 106, 173, and 235. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 692 and one or more residue differences or residue difference sets as compared to SEQ ID NO:

692, selected from: 52L/55L/106R/256G, 52L/55L/181R/235Q/256E, 52L/55L/181R/256G, 52L/99P/181R/235Q, 52L/106R/181R/235Q/256G, 52L/106R/235Q/256G, 52L/106R/256E, 52L/173L/235Q, 52L/235Q, 52L/235Q/256E, 55L/99P/181R/256G, 55L/99P/256G/350V, 55L/181R/235Q/256E/350V, 55L/256G, 99P/235Q, 106R, 173L, and 235Q. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 692 and one or more residue differences or residue difference sets as compared to SEQ ID NO: 692, selected from: F52L/M55L/E106R/C256G, F52L/M55L/S181R/E235Q/C256E, F52L/M55L/S181R/C256G, F52L/D99P/S181R/E235Q, F52L/E106R/S181R/E235Q/C256G, F52L/E106R/E235Q/C256G, F52L/E106R/C256E, F52L/F173L/E235Q, F52L/E235Q, F52L/E235Q/C256E, M55L/D99P/S181R/C256G, M55L/D99P/C256G/H350V, M55L/S181R/E235Q/C256E/H350V, M55L/C256G, D99P/E235Q, E106R, F173L, and E235Q.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4 and one or more residue differences or residue difference sets as compared to SEQ ID NO: 4, selected from: 20/21/52/67/68/87/111/157/160/173/180/200/235/246/315, 20/21/55/67/68/87/111/157/160/180/181/200/235/246/256/315/350, 20/21/55/67/68/87/111/157/160/180/200/246/256/315, 20/21/60/72/160/180/200/246/259/338/358, 20/21/67/68/87/111/157/160/180/200/235/246/315, 20/21/67/68/87/111/157/160/180/200/246/315, and 20/21/68/160/180/200/246. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4 and one or more residue differences or residue difference sets as compared to SEQ ID NO: 4, selected from: 20G/21G/52L/67A/68R/87S/111T/157A/160S/173L/180A/200R/235Q/246G/315V, 20G/21G/55L/67A/68R/87S/111T/157A/160S/180A/181R/200R/235Q/246G/256E/315V/350V, 20G/21G/55L/67A/68R/87S/111T/157A/160S/180A/200R/246G/256G/315V, 20G/21G/60K/72K/160S/180A/200R/246G/259K/338K/358R, 20G/21G/67A/68R/87S/111T/157A/160S/180A/200R/235Q/246G/315V, 20G/21G/67A/68R/87S/111T/157A/160S/180A/200R/246G/315V, and 20G/21G/68R/160S/180A/200R/246G. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4 and one or more residue differences or residue difference sets as compared to SEQ ID NO: 4, selected from: L20G/E21G/F52L/F67A/C68R/R87S/E111T/L157A/D160S/F173L/V180A/S200R/E235Q/L246G/I315, L20G/E21G/M55L/F67A/C68R/R87S/E1I1T/L157A/D160S/V180A/S181R/S200R/E235Q/L246G/C256E/I315V/H350V, L20G/E21G/M55L/F67A/C68R/R87S/E111T/L157A/D160S/V180A/S200R/L246G/C256G/315V, L20G/E21G/E60K/L72K/D160S/V180A/S200R/L246G/I259K/R338K/N358R, L20G/E21G/F67A/C68R/R87S/E111T/L157A/D160S/V180A/S200R/E235Q/L246G/315V, L20G/E21G/F67A/

C68R/R87S/E111T/L157A/D160S/V180A/S200R/L246G/I315V, and L20G/E21G/C68R/D160S/V180A/S200R/L246G.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 882 and one or more residue differences or residue difference sets as compared to SEQ ID NO: 882, selected from: 63, 68, 72, 211, 220, 275, 349, and 350. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 882 and one or more residue differences or residue difference sets as compared to SEQ ID NO: 882, selected from: 63G, 68M, 72R, 211C, 220R, 275R, 349E, 349M, 349R, 350E, and 350Y. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 882 and one or more residue differences or residue difference sets as compared to SEQ ID NO: 882, selected from: E63G, C68M, K72R, T211C, M220R, A275R, S349E, S349M, S349R, H350E, and H350Y.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 882 and one or more residue differences or residue difference sets as compared to SEQ ID NO: 882, selected from: 20/21, 20/21/67, 20/21/67/87, 20/21/67/87/111, 20/21/67/87/111/200, 20/21/67/87/111/315, 20/21/67/87/157/180, 20/21/67/87/246/315, 20/21/67/160, 20/21/87/111/246/315, 20/21/87/157/200, 20/21/87/180/246/315, 20/21/87/315, 20/21/111/157/315, 20/21/111/246, 20/21/315, 20/67/87/111/180, 20/67/87/157/160/180/315, 20/68/111/157/160, 20/68/160/200/246, 20/87/111/180, 20/87/157/160, 20/160/315, 20/200, 21, 21/67/87/111/200, 21/67/87/157/246, 21/67/180/315, 21/67/200, 21/87/157/160, 21/87/160/200/315, 21/87/160/315, 21/87/200, 21/87/246/315, 21/111, 21/157/160, 21/160/315, 21/200/315, 21/246, 67, 67/87, 67/87/111/157/160/315, 67/111, 67/157/160/180, 67/157/160/315, 67/160, 67/180/200, 67/180/200/315, 67/315, 68/87, 68/157/160/200/315, 87, 87/111, 87/111/200, 87/111/200/246, 87/157, 87/157/180/200, 111/157/180/200/315, 157, 157/160, 246, and 315. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 882 and one or more residue differences or residue difference sets as compared to SEQ ID NO: 882, selected from: 20L/21E, 20L/21E/67A, 20L/21E/67A/87S, 20L/21E/67A/87S/111T, 20L/21E/67A/87S/111T/200S, 20L/21E/67A/87S/111T/315V, 20L/21E/67A/87S/157A/180V, 20L/21E/67A/87S/246L/315V, 20L/21E/67A/160D, 20L/21E/87S/111T/246L/315V, 20L/21E/87S/157A/200S, 20L/21E/87S/180V/246L/315V, 20L/21E/87S/315V, 20L/21E/111T/157A/315V, 20L/21E/111T/246L, 20L/21E/315V, 20L/67A/87S/111T/180V, 20L/67A/87S/157A/160D/180V/315V, 20L/68R/111T/157A/160D, 20L/68R/160D/200S/246L, 20L/87S/111T/180V, 20L/87S/157A/160D, 20L/160D/315V, 20L/200S, 21E, 21E/67A/87S/111T/200S, 21E/67A/87S/157A/246L, 21E/67A/180V/315V, 21E/67A/200S, 21E/87S/157A/160D, 21E/87S/160D/200S/315V, 21E/87S/160D/315V, 21E/87S/200S, 21E/87S/246L/315V, 21E/111T, 21E/157A/160D, 21E/160D/315V, 21E/200S/315V, 21E/246L, 67A, 67A/87S, 67A/87S/111T/157A/160D/315V, 67A/111T, 67A/157A/160D/180V, 67A/157A/160D/315V, 67A/160D, 67A/180V/200S, 67A/180V/200S/315V, 67A/315V, 68R/87S, 68R/157A/160D/200S/315V, 87S, 87S/111T, 87S/111T/200S, 87S/111T/200S/246L, 87S/157A, 87S/157A/180V/200S, 111T/157A/180V/200S/315V, 157A, 157A/160D, 246L, and 315V. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 882 and one or more residue differences or residue difference sets as compared to SEQ ID NO: 882, selected from: G20L/G21E, G20L/G21E/F67A, G20L/G21E/F67A/R87S, G20L/G21E/F67A/R87S/E111T, G20L/G21E/F67A/R87S/E111T/R200S, G20L/G21E/F67A/R87S/E111T/I315V, G20L/G21E/F67A/R87S/L157A/A180V, G20L/G21E/F67A/R87S/G246L/I315V, G20L/G21E/F67A/S160D, G20L/G21E/R87S/E111T/G246L/I315V, G20L/G21E/R87S/L157A/R200S, G20L/G21E/R87S/A180V/G246L/I315V, G20L/G21E/R87S/I315V, G20L/G21E/E111T/L157A/I315V, G20L/G21E/E111T/G246L, G20L/G21E/I315V, G20L/F67A/R87S/E111T/A180V, G20L/F67A/R87S/L157A/S160D/A180V/I315V, G20L/C68R/E111T/L157A/S160D, G20L/C68R/S160D/R200S/G246L, G20L/R87S/E111T/A180V, G20L/R87S/L157A/S160D, G20L/S160D/I315V, G20L/R200S, G21E, G21E/F67A/R87S/E111T/R200S, G21E/F67A/R87S/L157A/G246L, G21E/F67A/A180V/I315V, G21E/F67A/R200S, G21E/R87S/L157A/S160D, G21E/R87S/S160D/R200S/I315V, G21E/R87S/S160D/I315V, G21E/R87S/R200S, G21E/R87S/G246L/I315V, G21E/E111T, G21E/L157A/S160D, G21E/S160D/I315V, G21E/R200S/I315V, G21E/G246L, F67A, F67A/R87S, F67A/R87S/E111T/L157A/S160D/I315V, F67A/E111T, F67A/L157A/S160D/A180V, F67A/L157A/S160D/I315V, F67A/S160D, F67A/A180V/R200S, F67A/A180V/R200S/I315V, F67A/I315V, C68R/R87S, C68R/L157A/S160D/R200S/I315V, R87S, R87S/E111T, R87S/E111T/R200S, R87S/E111T/R200S/G246L, R87S/L157A, R87S/L157A/A180V/R200S, E111T/L157A/A180V/R200S/I315V, L157A, L157A/S160D, G246L, and I315V.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 914 and one or more residue differences or residue difference sets as compared to SEQ ID NO: 914, selected from: 52, 52/180, 52/180/200/235/315/349, 52/180/200/349, 52/180/349, 52/200, 52/200/315, 52/200/349, 52/200/349/350, 52/315, 52/315/349, 52/349, 52/349/350, 180, and 349. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 914 and one or more residue differences or residue difference sets as compared to SEQ ID NO: 914, selected from: 52L, 52L/180V, 52L/180V/200S/235Q/315V/349E, 52L/180V/200S/349E, 52L/180V/349E, 52L/200S, 52L/200S/315V, 52L/200S/349E, 52L/200S/349E/350E, 52L/315V, 52L/315V/349E, 52L/349E, 52L/349E/350E, 180V, and 349E. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 914 and one or more residue differences or residue difference sets as compared to SEQ ID NO: 914, selected from: F52L, F52L/A180V, F52L/A180V/R200S/E235Q/I315V/S349E, F52L/A180V/R200S/S349E, F52L/A180V/S349E, F52L/R200S, F52L/R200S/I315V, F52L/R200S/S349E, F52L/R200S/S349E/H350E, F52L/I315V, F52L/I315V/S349E, F52L/S349E, F52L/S349E/H350E, A180V, and S349E.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1034 and one or more residue differences or residue difference sets as compared to SEQ ID NO: 1034, selected from: 53/219/358, 55, 55/99/103, 55/99/219/358/373, 55/103/181, 55/103/219, 55/103/338, 55/181/219, 55/181/246, 55/181/358, 55/219/246/358, 55/219/256/338, 55/256/259, 99/103/219, 103/219/256, 103/219/338/358, 103/256, 103/259, 106/173/200/235/315, 106/173/388, 111/173, 111/173/235/315, 173, 173/297, 181, 219, 219/358, 256, 256/259, and 358. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1034 and one or more residue differences or residue difference sets as compared to SEQ ID NO: 1034, selected from: 53Q/219P/358N, 55L, 55L/99P/103A, 55L/99P/219P/358N/373D, 55L/103A/181R, 55L/103A/219P, 55L/103A/338R, 55L/181R/219P, 55L/181R/246G, 55L/181R/358N, 55L/219P/246G/358N, 55L/219P/256G/338R, 55L/256G/259I, 99P/103A/219P, 103A/219P/256E, 103A/219P/338R/358N, 103A/256G, 103A/259I, 106R/173L/200S/235Q/315V, 106R/173L/388Q, 111T/173L, 111T/173L/235Q/315V, 173L, 173L/297A, 181R, 219P, 219P/358N, 256E, 256G, 256G/259I, and 358N. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1034 and one or more residue differences or residue difference sets as compared to SEQ ID NO: 1034, selected from: E53Q/K219P/R358N, M55L, M55L/D99P/D103A, M55L/D99P/K219P/R358N/G373D, M55L/D103A/S181R, M55L/D103A/K219P, M55L/D103A/K338R, M55L/S181R/K219P, M55L/S181R/L246G, M55L/S181R/R358N, M55L/K219P/L246G/R358N, M55L/K219P/C256G/K338R, M55L/C256G/K259I, D99P/D103A/K219P, D103A/K219P/C256E, D103A/K219P/K338R/R358N, D103A/C256G, D103A/K259I, E106R/F173L/R200S/E235Q/I315V, E106R/F173L/E388Q, E111T/F173L, E111T/F173L/E235Q/I315V, F173L, F173L/S297A, S181R, K219P, K219P/R358N, C256E, C256G, C256G/K2591, and R358N.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1034 and one or more residue differences or residue difference sets as compared to SEQ ID NO: 1034, selected from: 48, 52, 53/219/358, 55, 55/99/219/358/373, 55/181/358, 55/219/246/358, 55/256, 56, 58, 62, 65, 66, 70, 71, 74, 77, 78, 79, 103/219/338/358, 219, 219/358, 328, 345, 350, 353, 355, and 358. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1034 and one or more residue differences or residue difference sets as compared to SEQ ID NO: 1034, selected from: 48T, 52A, 53Q/219P/358N, 55L, 55L/99P/219P/358N/373D, 55L/181R/358N, 55L/219P/246G/358N, 55L/256E, 56V, 58D, 62G, 65L, 66P, 66S, 70V, 71A, 74G, 771, 77V, 78F, 79R, 103A/219P/338R/358N, 219L, 219P/358N, 219V, 328F, 345V, 350T, 353S, 355V, and 358N. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1034 and one or more residue differences or residue difference sets as compared to SEQ ID NO: 1034, selected from: F48T, L52A, E53Q/K219P/R358N, M55L, M55L/D99P/K219P/R358N/G373D, M55L/S181R/R358N, M55L/K219P/L246G/R358N, M55L/C256E, A56V, N58D, K62G, E65L, I66P, I66S, E70V, F71A, A74G, L77I, L77V, L78F, K79R, D103A/K219P/K338R/R358N, K219L, K219P/R358N, K219V, A328F, R345V, E350T, K353S, I355V, and R358N.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1034 and one or more residue differences or residue difference sets as compared to SEQ ID NO: 1034, selected from: 47, 48, 51, 52, 54, 55, 57, 58, 59, 61, 62, 63, 64, 65, 66, 69, 70, 71, 73, 74, 77, 79, 131, 133, 134, 219, 319, 321, 322, 325, 328, 332, 345, 350, 351, 352, 353, and 355. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1034 and one or more residue differences or residue difference sets as compared to SEQ ID NO: 1034, selected from: 47Q, 481, 48Y, 51L, 51S, 52A, 54N, 54V, 55R, 57C, 58C, 58D, 58M, 58S, 59W, 61T, 62G, 62R, 62W, 63D, 64Q, 64R, 65L, 66P, 66R, 66S, 69I, 70A, 70H, 70I, 70V, 71A, 71S, 73G, 74G, 77I, 77V, 79R, 131V, 133Y, 134M, 134V, 219L, 219V, 319F, 321V, 322S, 325S, 328F, 328P, 328S, 328W, 332C, 345A, 345Q, 345V, 350S, 351Q, 352A, 352S, 353G, 353M, 353Q, 355A, 355L, and 355V. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1034 and one or more residue differences or residue difference sets as compared to SEQ ID NO: 1034, selected from: K47Q, F48I, F48Y, A51L, A51S, L52A, I54N, I54V, M55R, E57C, N58C, N58D, N58M, N58S, Y59W, F61T, K62G, K62R, K62W, E63D, N64Q, N64R, E65L, I66P, I66R, I66S, L69I, E70A, E70H, E70I, E70V, F71A, F71S, R73G, A74G, L77I, L77V, K79R, Q131V, T133Y, S134M, S134V, K219L, K219V, L319F, I321V, T322S, E325S, A328F, A328P, A328S, A328W, L332C, R345A, R345Q, R345V, E350S, E351Q, R352A, R352S, K353G, K353M, K353Q, I355A, I355L, and I355V.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1270 and one or more residue differences or residue difference sets as compared to SEQ ID NO: 1270, selected from: 23, 32, 36, 40, 49, 93, 98, 107, 117, 124, 165, 182, 186, 269, 288, 309, 374, 377, and 386. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1270 and one or more residue differences or residue difference sets as compared to SEQ ID NO: 1270, selected from: 23L, 32H, 36H, 40S, 49S, 93Q, 93W, 98P, 107G, 107S, 117I, 124P, 165M, 182G, 186D, 186R, 269R, 288H, 309K, 374E, 374G, 377N, and 386V. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1270 and one or more residue differences or residue difference sets as compared to SEQ ID NO: 1270, selected from: P23L, Q32H, Q36H, T40S, T49S, G93Q, G93W, G98P, E107G, E107S, V117I, E124P, L165M, C182G, A186D, A186R, P269R, L288H, V309K, S374E, S374G, E377N, and Y386V.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1270 and one or more residue differences or residue difference sets as compared to SEQ ID NO: 1270, selected from: 23, 40, 49, 107, 112, 120, 186, 271, 309, 374, and 377. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1270 and one or more residue differences or residue difference sets as compared to SEQ ID NO: 1270, selected from: 23L, 40S, 49S, 107G, 107S, 112T, 120T, 186D, 271Q, 309K, 374E, and 377N. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1270 and one or more residue differences or residue difference sets as compared to SEQ ID NO: 1270, selected from: P23L, T40S, T49S, E107G, E107S, G112T, V120T, A186D, R271Q, V309K, S374E, and E377N.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1270 and one or more residue differences or residue difference sets as compared to SEQ ID NO: 1270, selected from: 23, 182, 186, 269, 270, 293, 360, 372, and 378. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1270 and one or more residue differences or residue difference sets as compared to SEQ ID NO: 1270, selected from: 23V, 182A, 182R, 186E, 269A, 270T, 293G, 360A, 372G, and 378C. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1270 and one or more residue differences or residue difference sets as compared to SEQ ID NO: 1270, selected from: P23V, C182A, C182R, A186E, P269A, S270T, V293G, G360A, A372G, and I378C.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1344 and one or more residue differences or residue difference sets as compared to SEQ ID NO: 1344, selected from: 55/58/256/350/373, 58, 58/69/256/373, 58/99/351/355, 58/256, 70/71, 70/71/353, 70/134/353, 70/353, 71/77/353, 71/353, 77, 77/134/353, 77/353, 99/256/351/355, 134/353, 256, 350, and 353. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1344 and one or more residue differences or residue difference sets as compared to SEQ ID NO: 1344, selected from: 55R/58D/256E/350S/373D, 58D, 58S/691/256E/373D, 58S/99V/351Q/355A, 58S/256E, 70V/71A, 70V/71A/353G, 70V/134M/353G, 70V/353M, 71A/771/353G, 71A/353G, 771, 771/134V/353G, 771/353M, 99V/256E/351Q/355A, 134V/353G, 256E, 350S, 353G, and 353M. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1344 and one or more residue differences or residue difference sets as compared to SEQ ID NO: 1344, selected from: M55R/N58D/C256E/E350S/G373D, N58D, N58S/L691/C256E/G373D, N58S/D99V/E351Q/I355A, N58S/C256E, E70V/F71A, E70V/F71A/K353G, E70V/S134M/K353G, E70V/K353M, F71A/L771/K353G, F71A/K353G, L771, L771/S134V/K353G, L771/K353M, D99V/C256E/E351Q/I355A, S134V/K353G, C256E, E350S, K353G, and K353M.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1344 and one or more residue differences or residue difference sets as compared to SEQ ID NO: 1344, selected from: 55/58, 55/58/69/350/351, 55/58/99/256/351/373, 55/58/99/256/355, 55/58/99/351, 55/58/256, 55/58/256/355, 55/58/350/351, 58/99, 58/99/355, 58/256/350/355, 58/350/355, 70, 70/353, 71/77/133/353, 71/353, 77/133/353, 77/353, 133, 353, and 355/373. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1344 and one or more residue differences or residue difference sets as compared to SEQ ID NO: 1344, selected from: 55R/58M, 55R/58M/691/350S/351Q, 55R/58M/256E, 55R/58S/99V/256E/351Q/373D, 55R/58S/99V/256E/355A, 55R/58S/99V/351Q, 55R/58S/256E/355A, 55R/58S/350S/351Q, 58D/99V/355V, 58M/256E/350S/355V, 58S/99V, 58S/350S/355V, 70L, 70V/353G, 71A/771/133Y/353M, 71A/353G, 771/133Y/353G, 771/133Y/353M, 771/353G, 133Y, 353G, 353M, and 355V/373D. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1344 and one or more residue differences or residue difference sets as compared to SEQ ID NO: 1344, selected from: M55R/N58M, M55R/N58M/L69I/E350S/E351Q, M55R/N58M/C256E, M55R/N58S/D99V/C256E/E351Q/G373D, M55R/N58S/D99V/C256E/I355A, M55R/N58S/D99V/E351Q, M55R/N58S/C256E/I355A, M55R/N58S/E350S/E351Q, N58D/D99V/I355V, N58M/C256E/E350S/I355V, N58S/D99V, N58S/E350S/I355V, E70L, E70V/K353G, F71A/L77I/T133Y/K353M, F71A/K353G, L77I/T133Y/K353G, L77I/T133Y/K353M, L77I/K353G, T133Y, K353G, K353M, and I355V/G373D.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1344 and one or more residue differences or residue difference sets as compared to SEQ ID NO: 1344, selected from: 8, 9, 14, 15, 16, 28, 29, 42, 89, 100, 116, 125, 190, 197, 201, 233, 237, 289, 298, 302, 364, 368, and 380. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1344 and one or more residue differences or residue difference sets as compared to SEQ ID NO: 1344, selected from: 8S, 9D, 14E, 14G, 15E, 16G, 28G, 29R, 42V, 89G, 89Y, 100E, 116L, 125K, 190V, 197G, 201G, 233R, 237A, 237G, 289G, 298D, 302A, 302G, 364F, 364W, 368S, and 380G. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1344 and one or more residue differences or residue difference sets as compared to SEQ ID NO: 1344, selected from: G8S, G9D, P14E, P14G, S15E, N16G, R28G, K29R, N42V, K89G, K89Y, Q100E, R116L, R125K, A190V, N197G, T201G, P233R, D237A, D237G, Y289G, Y298D, K302A, K302G, R364F, R364W, I368S, and A380G.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1344 and one or more residue differences or residue difference sets as compared to SEQ ID NO: 1344, selected from: 9, 14, 28, 86, 89, 91, 92, 104, 116, 125, 196, 197, 198, 201, 230, 234, 248, 266, 272, 278, 298, 304, 307, 308, 341, 364, 365, and 380. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1344 and one or more residue differences or residue difference sets as compared to SEQ ID NO: 1344, selected from: 9E, 141, 281, 28S, 86Q, 89D, 91C, 91V, 92A, 92F, 92V, 1041, 116T, 125A, 125F, 196C, 196F, 196R, 197R, 198C, 201L, 230D, 230I, 234Q, 248L, 248W, 266Q, 272G, 278S, 298V, 304V, 307L, 308D, 341E, 341T, 364L, 364N, 365G, 380G, and 380M. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1344 and one or more residue differences or residue difference sets as compared to SEQ ID NO: 1344, selected from: G9E, P14I, R28I, R28S, T86Q, K89D, I91C, I91V, Q92A, Q92F, Q92V, V104I, R116T, R125A, R125F, K196C, K196F, K196R, N197R, T198C, T201L, N230D, N230I, K234Q, K248L, K248W, E266Q, K272G, N278S, Y298V, S304V, A307L, E308D, G341E, G341T, R364L, R364N, K365G, A380G, and A380M.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1346 and one or more residue differences or residue difference sets as compared to SEQ ID NO: 1346, selected from: 27, 28, 29, 84, 92, 98, 110, 143, 147, 158, 162, 170, 173, 174, 181, 185, 193, 197, 204, 204/264/340, 290, 297, and 303. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1346 and one or more residue differences or residue difference sets as compared to SEQ ID NO: 1346, selected from: 27L, 28E, 28G, 29C, 29P, 84E, 92E, 98A, 98T, 110L, 143A, 147Y, 158R, 162A, 170R, 173L, 174M, 181R, 185R, 193R, 193S, 193V, 197E, 204E/264L/340L, 204F, 204I, 204L, 204M, 204R, 290R, 290V, 297A, 303G, and 303T. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1346 and one or more residue differences or residue difference sets as compared to SEQ ID NO: 1346, selected from: A27L, R28E, R28G, K29C, K29P, P84E, Q92E, G98A, G98T, E110L, S143A, F147Y, K158R, S162A, K170R, F173L, L174M, S181R, K185R, L193R, L193S, L193V, N197E, P204E/V264L/F340L, P204F, P204I, P204L, P204M, P204R, Q290R, Q290V, S297A, K303G, and K303T.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1346 and one or more residue differences or residue difference sets as compared to SEQ ID NO: 1346, selected from: 38, 44, 57/367, 66, 92, 101, 102, 111, 143, 147, 154, 156, 158, 160, 167, 173, 184, 185, 196, 197, 224, 233, 248, 324, and 352. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1346 and one or more residue differences or residue difference sets as compared to SEQ ID NO: 1346, selected from: 38R, 44H, 57D/367K, 66G, 92E, 101S, 102K, HID, 143A, 147Y, 154L, 156D, 158R, 160E, 167R, 173L, 184T, 185R, 196E, 197E, 224V, 233E, 248E, 3241, and 352K. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1346 and one or more residue differences or residue difference sets as compared to SEQ ID NO: 1346, selected from: K38R, Y44H, E57D/R367K, 166G, Q92E, V101S, R102K, E111D, S143A, F147Y, V154L, E156D, K158R, S160E, K167R, F173L, S184T, K185R, K196E, N197E, I224V, P233E, K248E, F3241, and R352K.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1346 and one or more residue differences or residue difference sets as compared to SEQ ID NO: 1346, selected from: 23/186/256/309, 58/186/270, 182/186/256/360, 182/256, 186/256, 186/256/270, 256, and 270/309. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1346 and one or more residue differences or residue difference sets as compared to SEQ ID NO: 1346, selected from: 23V/186E/256E/309K, 58S/186E/270T, 182R/186E/256E/360A, 182R/256E, 186E/256E, 186E/256E/270T, 256E, and 270T/309K. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1346 and one or more residue differences or residue difference sets as compared to SEQ ID NO: 1346, selected from: P23V/A186E/C256E/V309K, N58S/A186E/S270T, C182R/A186E/C256E/G360A, C182R/C256E, A186E/C256E, A186E/C256E/S270T, C256E, and S270T/V309K.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1678 and one or more residue differences or residue difference sets as compared to SEQ ID NO: 1678, selected from: 341. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1678 and one or more residue differences or residue difference sets as compared to SEQ ID NO: 1678, selected from: 341C, 341H, 341I, 341K, 341L, 341M, 341R, 341T, and 341V. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1678 and one or more residue differences or residue difference sets as compared to SEQ ID NO: 1678, selected from: G341C, G341H, G341I, G341K, G341L, G341M, G341R, G341T, and G341V.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1678 and one or more residue differences or residue difference sets as compared to SEQ ID NO: 1678, selected from: 9/14/58, 9/14/58/182/190/197/298, 9/14/190/197/364, 9/58/197, 9/298, 10/14/197/364, 14/58/182/197/298/364, 14/190/197/298, 14/197/298/364, 14/298/364, 58/197, 58/197/364, 58/364, 182, 182/197, 182/298/364, 197/298, and 298. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1678 and one or more residue differences or residue difference sets as compared to SEQ ID NO: 1678, selected from: 9D/14I/58S, 9D/298V, 9E/14I/58S/182C/190V/197G/298V, 9E/14I/190V/197G/364L, 9E/58S/197G, 10I/14I/197G/364L, 14I/58S/182C/197G/298V/364L, 14I/190V/197G/298V, 14I/197G/298V/364L, 14I/298V/364F, 58S/197G, 58S/197G/364L, 58S/364L, 182C, 182C/197G, 182C/298V/364L, 197G/298V, and 298V. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1678 and one or more residue differences or residue difference sets as compared to SEQ ID NO: 1678, selected from: G9D/P14I/N58S, G9D/Y298V, G9E/P14I/N58S/R182C/A190V/N197G/Y298V, G9E/P14I/A190V/N197G/R364L, G9E/N58S/N197G, S10I/P14I/N197G/R364L, P14I/N58S/R182C/N197G/Y298V/R364L, P14I/A190V/N197G/Y298V, P14I/N197G/Y298V/R364L, P14I/Y298V/R364F, N58S/N197G, N58S/N197G/R364L, N58S/R364L, R182C, R182C/N197G, R182C/Y298V/R364L, N197G/Y298V, and Y298V.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1700 and one or more residue differences or residue difference sets as compared to SEQ ID NO: 1700, selected from: 18/28/147/303, 28, 28/84, 28/84/92/147/204, 28/84/147/204, 28/84/156/173/204/290/303, 28/84/173/204/303, 28/84/173/303, 28/84/303, 28/92/147, 28/92/147/204/290/303, 28/92/156/204/290, 28/92/204, 28/147/303, 28/156/204, 28/204, 28/290, 28/303, 29, 29/98/143/266, 29/98/185/197/266, 29/98/185/266/296/299, 29/143, 29/143/162, 29/143/170/193/197/266, 29/143/185/193/266, 29/158/266, 29/170/185/193/266/299, 29/185/296, 29/193/197/296/297, 72, 84, 84/92/173, 84/156/173/204, 84/173/204/303, 92/173/204/290/303, 98, 98/143/158/170/185/296/297, 98/143/162/266, 98/143/185/266, 98/162/193, 98/170/193/197, 98/185, 98/185/193/197/266/297, 143, 143/158/197/266, 143/266/296/297, 147/290/303/307, 170/193/197, 173, 173/204, 173/204/303, 182, 204, 266/297/299, and 303. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1700 and one or more residue differences or residue difference sets as compared to SEQ ID NO: 1700, selected from: 18Q/28G/147Y/303G, 28E/84E, 28E/84E/92E/147Y/204R, 28E/84E/156D/173L/204M/290R/303G, 28E/84E/173L/303G, 28E/92E/147Y, 28E/290R, 28G, 28G/84E/147Y/204L, 28G/84E/173L/204R/303T, 28G/84E/303G, 28G/92E/147Y/2041/290R/303G, 28G/92E/156D/204L/290R, 28G/92E/204R, 28G/147Y/303G, 28G/156D/2041, 28G/204R, 28G/303G, 29P, 29P/98A/185R/197E/266G, 29P/98T/143A/266G, 29P/98T/185R/266G/296N/299G, 29P/143A, 29P/143A/162A, 29P/143A/170R/193S/197E/266G, 29P/143A/185R/193S/266G, 29P/158R/266G, 29P/170R/185R/193S/266G/299G, 29P/185R/296N, 29P/193V/197E/296N/297A, 72R, 84E, 84E/92E/173L, 84E/156D/173L/204F, 84E/173L/204F/303T, 92E/173L/204F/290V/303G, 98A/185R, 98A/185R/193S/197E/266G/297A, 98T, 98T/143A/158R/170R/185R/296N/297A, 98T/143A/162A/266G, 98T/143A/185R/266G, 98T/

162A/193V, 98T/170R/1935/197E, 143A, 143A/158R/197E/266G, 143A/266G/296N/297A, 147Y/290R/303T/307V, 170R/193S/197E, 173L, 173L/204F/303G, 173L/204R, 182G, 204R, 266G/297A/299G, and 303G. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1700 and one or more residue differences or residue difference sets as compared to SEQ ID NO: 1700, selected from: P18Q/R28G/F147Y/K303G, R28E/P84E, R28E/P84E/Q92E/F147Y/P204R, R28E/P84E/E156D/F173L/P204M/Q290R/K303G, R28E/P84E/F173L/K303G, R28E/Q92E/F147Y, R28E/Q290R, R28G, R28G/P84E/F147Y/P204L, R28G/P84E/F173L/P204R/K303T, R28G/P84E/K303G, R28G/Q92E/F147Y/P204I/Q290R/K303G, R28G/Q92E/E156D/P204L/Q290R, R28G/Q92E/P204R, R28G/F147Y/K303G, R28G/E156D/P204I, R28G/P204R, R28G/K303G, K29P, K29P/G98A/K185R/N197E/E266G, K29P/G98T/S143A/E266G, K29P/G98T/K185R/E266G/S296N/N299G, K29P/S143A, K29P/S143A/S162A, K29P/S143A/K170R/L193S/N197E/E266G, K29P/S143A/K185R/L193S/E266G, K29P/K158R/E266G, K29P/K170R/K185R/L193S/E266G/N299G, K29P/K185R/S296N, K29P/L193V/N197E/S296N/S297A, K72R, P84E, P84E/Q92E/F173L, P84E/E156D/F173L/P204F, P84E/F173L/P204F/K303T, Q92E/F173L/P204F/Q290V/K303G, G98A/K185R, G98A/K185R/L193S/N197E/E266G/S297A, G98T, G98T/S143A/K158R/K170R/K185R/S296N/S297A, G98T/S143A/S162A/E266G, G98T/S143A/K185R/E266G, G98T/S162A/L193V, G98T/K170R/L193S/N197E, S143A, S143A/K158R/N197E/E266G, S143A/E266G/S296N/S297A, F147Y/Q290R/K303T/A307V, K170R/L193S/N197E, F173L, F173L/P204F/K303G, F173L/P204R, R182G, P204R, E266G/S297A/N299G, and K303G.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1700 and one or more residue differences or residue difference sets as compared to SEQ ID NO: 1700, selected from: 29, 60, 72, 84, 147, 182, 211, 220, 224, 266, 290, 338, 339, 342, and 345. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1700 and one or more residue differences or residue difference sets as compared to SEQ ID NO: 1700, selected from: 29P, 60T, 72E, 72G, 72Q, 72S, 72W, 84E, 147Y, 182A, 182F, 182G, 182N, 182Q, 182S, 182W, 182Y, 211A, 211V, 220L, 220S, 220V, 220Y, 224A, 224C, 224T, 224V, 266G, 290R, 338A, 338G, 339C, 342A, 3451, and 345K. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1700 and one or more residue differences or residue difference sets as compared to SEQ ID NO: 1700, selected from: K29P, K60T, K72E, K72G, K72Q, K72S, K72W, P84E, F147Y, R182A, R182F, R182G, R182N, R182Q, R182S, R182W, R182Y, T211A, T211V, M220L, M220S, M220V, M220Y, I224A, I224C, I224T, I224V, E266G, Q290R, K338A, K338G, E339C, R342A, R345I, and R345K.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1750 and one or more residue differences or residue difference sets as compared to SEQ ID NO: 1750, selected from: 9, 9/28/156/158/173/190/193/303/364, 9/28/156/158/290/364, 9/28/190/193/303/364, 9/28/290/303/364, 9/156/158/193/290/303/364, 9/156/364, 9/290/364, 9/364, 14, 14/58/84/147/162/224/296/297/298/299, 14/58/84/147/162/224/296/297/299, 14/58/84/224/298, 14/84/147/193/197/224/296, 14/84/162/224/297/299, 14/84/224/296/299, 14/162/224/298/299, 14/224/296/298, 23/28/156/158/190/193/290/364, 28/156/173/364, 28/158/173/190/193/290/364, 28/190/193, 28/296/303/364, 28/364, 58/147/162/197/224/296/297/298/299, 58/162/224/296/298, 58/224, 58/224/299, 84/147, 147/224, 147/224/297/298, 156/158/190/193/364, 158/193/290/303, 193/290, 224/296/298, 224/297/299, 290/303/364, 303, and 364. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1750 and one or more residue differences or residue difference sets as compared to SEQ ID NO: 1750, selected from: 9D, 9D/28E/156D/158R/290R/364L, 9D/28E/190V/193S/303G/364L, 9D/28E/290R/303G/364L, 9D/28G/156D/158R/173L/190V/193S/303G/364L, 9D/156D/158R/193V/290R/303G/364L, 9D/156D/364L, 9D/290R/364L, 9D/364L, 14I, 14I/58S/84E/147Y/162A/224V/296N/297A/298V/299G, 14I/58S/84E/147Y/162A/224V/296N/297A/299G, 14I/58S/84E/224V/298V, 14I/84E/147Y/193S/197E/224V/296N, 14I/84E/162A/224V/297A/299G, 14I/84E/224V/296N/299G, 14I/162A/224V/298V/299G, 14I/224V/296N/298V, 23S/28E/156D/158R/190V/193S/290R/364L, 28E/156D/173L/364L, 28G/156D/173L/364L, 28G/158R/173L/190V/193V/290R/364L, 28G/190V/193V, 28G/296G/303G/364L, 28G/364L, 58S/147Y/162A/197E/224V/296N/297A/298V/299G, 58S/162A/224V/296N/298V, 58S/224V, 58S/224V/299G, 84E/147Y, 147Y/224V, 147Y/224V/297A/298V, 156D/158R/190V/193V/364L, 158R/193V/290R/303G, 193V/290R, 224V/296N/298V, 224V/297A/299G, 290R/303G/364L, 303T, and 364L. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1750 and one or more residue differences or residue difference sets as compared to SEQ ID NO: 1750, selected from: G9D, G9D/R28E/E156D/K158R/Q290R/R364L, G9D/R28E/A190V/L193S/K303G/R364L, G9D/R28E/Q290R/K303G/R364L, G9D/R28G/E156D/K158R/F173L/A190V/L193S/K303G/R364L, G9D/E156D/K158R/L193V/Q290R/K303G/R364L, G9D/E156D/R364L, G9D/Q290R/R364L, G9D/R364L, P14I, P14I/N58S/P84E/F147Y/S162A/I224V/S296N/S297A/Y298V/N299G, P14I/N58S/P84E/F147Y/S162A/I224V/S296N/S297A/N299G, P14I/N58S/P84E/I224V/Y298V, P14I/P84E/F147Y/L193S/N197E/I224V/S296N, P14I/P84E/S162A/I224V/S297A/N299G, P14I/P84E/I224V/S296N/N299G, P14I/S162A/I224V/Y298V/N299G, P14I/I224V/S296N/Y298V, P23S/R28E/E156D/K158R/A190V/L193S/Q290R/R364L, R28E/E156D/F173L/R364L, R28G/E156D/F173L/R364L, R28G/K158R/F173L/A190V/L193V/Q290R/R364L, R28G/A190V/L193V, R28G/S296G/K303G/R364L, R28G/R364L, N58S/F147Y/

S162A/N197E/I224V/S296N/S297A/Y298V/N299G, N58S/S162A/I224V/S296N/Y298V, N58S/I224V, N58S/I224V/N299G, P84E/F147Y, F147Y/I224V, F147Y/I224V/S297A/Y298V, E156D/K158R/A190V/L193V/R364L, K158R/L193V/Q290R/K303G, L193V/Q290R, I224V/S296N/Y298V, I224V/S297A/N299G, Q290R/K303G/R364L, K303T, and R364L.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1750 and one or more residue differences or residue difference sets as compared to SEQ ID NO: 1750, selected from: 34, 48, 69, 78, 237/271, 249, 302, 309, 315, 353, 364, and 365. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1750 and one or more residue differences or residue difference sets as compared to SEQ ID NO: 1750, selected from 34A, 48L, 691, 78F, 237A/271H, 249T, 302G, 309K, 315V, 353Q, 364F, 364L, and 365G. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1750 and one or more residue differences or residue difference sets as compared to SEQ ID NO: 1750, selected from: S34A, F48L, L69I, L78F, D237A/R271H, K249T, K302G, V309K, I315V, G353Q, R364F, R364L, and K365G.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1932 and one or more residue differences or residue difference sets as compared to SEQ ID NO: 1932, selected from: 12, 14, 14/28/58/84/173/297, 14/28/58/162/190/193/224, 14/28/58/224, 14/28/224/296/298, 14/58/147/162/190/193/224/296/303, 14/58/158/224, 14/58/162, 14/147, 14/147/158/162/224, 14/147/173, 14/147/224, 14/158/162/197/224/296/298/299, 14/173/193/197/296/297/298/299, 14/193/197/224/297/298/299/300, 14/224/296/303, 28, 28/58/84/158/162/193/224/296/298/299, 28/58/147/224/296/297/298/299/303, 28/58/162/224/298/299, 28/84, 28/84/147/297/298, 28/224/296/297/298/303, 28/296/298, 58/72/211/315, 58/72/220/224, 58/84/211/220/224, 58/147/162/296/298, 66/220/224, 72, 72/84/86/224, 72/84/220/224/315, 72/86/220, 72/220/224, 72/220/315, 75, 77, 84/147/197/296/297, 84/147/297/298/303, 84/173/224, 84/220/315, 84/224/297/298/299, 100, 104, 120, 147, 147/158/162/190/224/296/297/299/303, 162/224, 173, 190/193/197, 193/197/296/303, 197, 220/224/315, 220/315, 224, 224/298/299, 233, 292, 297, 315, 353, and 367. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1932 and one or more residue differences or residue difference sets as compared to SEQ ID NO: 1932, selected from 12L, 141, 14I/28G/58S/84E/173L/297A, 14I/28G/58S/162A/190V/193V/224V, 14I/28G/58S/224V, 14I/28G/224V/296N/298V, 14I/58S/147Y/162A/190V/193V/224V/296N/303G, 14I/58S/158R/224V, 14I/58S/162A, 14I/147Y, 14I/147Y/158R/162A/224V, 14I/147Y/173L, 14I/147Y/224V, 14I/158R/162A/197E/224V/296N/298V/299G, 14I/173L/193V/197E/296N/297A/298V/299G, 14I/193V/197E/224V/297R/298W/299-/300A, 14I/224V/296N/303G, 28E/58S/84E/158R/162A/193V/224V/296N/298V/299G, 28E/58S/147Y/224V/296N/297A/298V/299G/303G, 28E/58S/162A/224V/298V/299G, 28G, 28G/84E, 28G/84E/147Y/297A/298V, 28G/224V/296N/297A/298V/303G, 28G/296N/298V, 58D/72Q/211A/315V, 58D/72Q/220V/224V, 58D/84E/211A/220V/224V, 58S/147Y/162A/296N/298V, 66P/220V/224V, 72G/84E/86Q/224V, 72G/84E/220V/224V/315V, 72Q, 72Q/86Q/220V, 72Q/220V/224V, 72Q/220V/315V, 75V, 77L, 77V, 84E/147Y/197E/296N/297A, 84E/147Y/297A/298V/303G, 84E/173L/224V, 84E/220V/315V, 84E/224V/297A/298V/299G, 100D, 104L, 1201, 147Y, 147Y/158R/162A/190V/224V/296N/297A/299G/303G, 162A/224V, 173L, 190V/193V/197E, 193V/197E/296N/303G, 197E, 220V/224V/315V, 220V/315V, 224V, 224V/298V/299G, 233G, 233R, 292K, 297A, 315V, 353D, and 367K. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1932 and one or more residue differences or residue difference sets as compared to SEQ ID NO: 1932, selected from: H12L, P14I, P14I/R28G/N58S/P84E/F173L/S297A, P14I/R28G/N58S/S162A/A190V/L193V/I224V, P14I/R28G/N58S/I224V, P14I/R28G/I224V/S296N/Y298V, P14I/N58S/F147Y/S162A/A190V/L193V/I224V/S296N/K303G, P14I/N58S/K158R/I224V, P14I/N58S/S162A, P14I/F147Y, P14I/F147Y/K158R/S162A/I224V, P14I/F147Y/F173L, P14I/F147Y/I224V, P14I/K158R/S162A/N197E/I224V/S296N/Y298V/N299G, P14I/F173L/L193V/N197E/S296N/S297A/Y298V/N299G, P14I/L193V/N197E/I224V/S297R/Y298W/N299-/T300A, P14I/I224V/S296N/K303G, R28E/N58S/P84E/K158R/S162A/L193V/I224V/S296N/Y298V/N299G, R28E/N58S/F147Y/I224V/S296N/S297A/Y298V/N299G/K303G, R28E/N58S/S162A/I224V/Y298V/N299G, R28G, R28G/P84E, R28G/P84E/F147Y/S297A/Y298V, R28G/I224V/S296N/S297A/Y298V/K303G, R28G/S296N/Y298V, N58D/K72Q/T211A/I315V, N58D/K72Q/M220V/I224V, N58D/P84E/T211A/M220V/I224V, N58S/F147Y/S162A/S296N/Y298V, I66P/M220V/I224V, K72G/P84E/T86Q/I224V, K72G/P84E/M220V/I224V/I315V, K72Q, K72Q/T86Q/M220V, K72Q/M220V/I224V, K72Q/M220V/I315V, A75V, I77L, I77V, P84E/F147Y/N197E/S296N/S297A, P84E/F147Y/S297A/Y298V/K303G, P84E/F173L/I224V, P84E/M220V/I315V, P84E/I224V/S297A/Y298V/N299G, Q100D, V104L, V120I, F147Y, F147Y/K158R/S162A/A190V/I224V/S296N/S297A/N299G/K303G, S162A/I224V, F173L, A190V/L193V/N197E, L193V/N197E/S296N/K303G, N197E, M220V/I224V/I315V, M220V/I315V, I224V, I224V/Y298V/N299G, P233G, P233R, G292K, S297A, I315V, G353D, and R367K.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1932 and one or more residue differences or residue difference sets as compared to SEQ ID NO: 1932, selected from: 12, 75, 77, 100, 104, 120, 197, 233, 292, 353, and 367. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1932 and one or more residue differences or residue difference sets as compared to SEQ ID NO: 1932, selected from 12L, 75V, 77L, 77V, 100D, 104L, 1201, 197E, 233G, 233R, 292K, 353D, and 367K. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 1932 and one or more residue differences or residue difference sets as compared to SEQ ID NO: 1932, selected from: H12L, A75V, I77L, I77V, Q100D, V104L, V120I, N197E, P233G, P233R, G292K, G353D, and R367K.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2164 and one or more residue differences or residue difference sets as compared to SEQ ID NO: 2164, selected from: 51, 52, 66, and 71. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2164 and one or more residue differences or residue difference sets as compared to SEQ ID NO: 2164, selected from 51V, 52V, 66E, 66S, and 71M. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2164 and one or more residue differences or residue difference sets as compared to SEQ ID NO: 2164, selected from: A51V, L52V, 166E, 166S, and A71M.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2164 and one or more residue differences or residue difference sets as compared to SEQ ID NO: 2164, selected from: 9/11, 20, 52, 74, 78, 80, 96, 101, 108, 111, 116, 145, 147, 173, 200, 203, 206, 232, 235, 242, 249, 264, 267, 288, 293, 304, 306, 308, 324, 326, 328, 350, 352, 361, 368, 374, 378, and 380. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2164 and one or more residue differences or residue difference sets as compared to SEQ ID NO: 2164, selected from 9D/11L, 20E, 20K, 20L, 20R, 20V, 52G, 74L, 78M, 80S, 96A, 101C, 108D, 111F, 111R, 116L, 116P, 145C, 145R, 145V, 147M, 173R, 2001, 200L, 203S, 203V, 206V, 232M, 235C, 235F, 235M, 235R, 235V, 242R, 249A, 249G, 264T, 267S, 288R, 293D, 293G, 304G, 304L, 306P, 308L, 324V, 326C, 328W, 350L, 350T, 352A, 361W, 368R, 374D, 378G, and 380S. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2164 and one or more residue differences or residue difference sets as compared to SEQ ID NO: 2164, selected from: G9D/G11L, G20E, G20K, G20L, G20R, G20V, L52G, A74L, L78M, Y80S, C96A, V101C, 1108D, E111F, E111R, R116L, R116P, K145C, K145R, K145V, F147M, F173R, R2001, R200L, L203S, L203V, A206V, G232M, E235C, E235F, E235M, E235R, E235V, K242R, K249A, K249G, V264T, Q267S, L288R, V293D, V293G, S304G, S304L, M306P, E308L, F324V, Q326C, A328W, E350L, E350T, R352A, L361W, I368R, S374D, I378G, and A380S.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2164 and one or more residue differences or residue difference sets as compared to SEQ ID NO: 2164, selected from: 97, 168, 259, 273, and 276. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2164 and one or more residue differences or residue difference sets as compared to SEQ ID NO: 2164, selected from 97L, 168A, 168Q, 259Q, 259V, 273V, and 276L. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2164 and one or more residue differences or residue difference sets as compared to SEQ ID NO: 2164, selected from: I97L, M168A, M168Q, K259Q, K259V, I273V, and M276L.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2164 and one or more residue differences or residue difference sets as compared to SEQ ID NO: 2164, selected from: 97, 135, 259, 273, 276, and 278. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2164 and one or more residue differences or residue difference sets as compared to SEQ ID NO: 2164, selected from 97L, 135I, 259Q, 259V, 273V, 276L, and 278A. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2164 and one or more residue differences or residue difference sets as compared to SEQ ID NO: 2164, selected from: I97L, V135I, K259Q, K259V, I273V, M276L, and N278A.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2164 and one or more residue differences or residue difference sets as compared to SEQ ID NO: 2164, selected from: 97, 135, 166, 273, and 278. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2164 and one or more residue differences or residue difference sets as compared to SEQ ID NO: 2164, selected from 97L, 135I, 166T, 273V, and 278A. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2164 and one or more residue differences or residue difference sets as compared to SEQ ID NO: 2164, selected from: I97L, V135I, S166T, I273V, and N278A.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2164 and one or more residue differences or residue difference sets as compared to SEQ ID NO: 2164, selected from: 97, 135, 140, 166, 167, 168, 230, 259, 273, 276, and 278. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2164 and one or more residue differences or residue difference sets as compared to SEQ ID NO: 2164, selected from 97F, 97L, 135I, 140L, 166N, 167R, 168Q, 230H, 259Q, 259V, 273V, 276L, 278A, and 278R. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2164 and one or more residue differences or residue difference sets as compared to SEQ ID NO: 2164, selected from: I97F, I97L, V135I, V140L, S166N, K167R, M168Q, N230H, K259Q, K259V, I273V, M276L, N278A, and N278R.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2164 and one or more residue differences or residue difference sets as compared to SEQ ID NO: 2164, selected from: 34, 34/48/78/133/147/182, 34/48/78/147/158, 34/48/78/147/182/220/233/249/307/315/339, 34/48/78/158/182/220/249/307, 34/48/78/158/182/233/315/345, 34/48/78/182/220/230/315, 34/48/78/182/220/233, 34/48/133/158/182/230/233/271/345, 34/48/147, 34/48/147/158/182/220/233/307, 34/48/147/182/230/233/249/307, 34/48/147/271, 34/48/182/233/249, 34/48/339, 34/78, 34/78/84/147/158/182/220, 34/78/84/158/230, 34/78/147/182/220/249, 34/78/147/182/233/249/315, 34/78/147/182/233/271/339, 34/78/158, 34/78/158/182/315/345, 34/78/158/249, 34/78/182/233/307, 34/78/204/220/339, 34/78/220/271, 34/78/220/307/339, 34/78/315, 34/133/147/158/230/233/249, 34/147, 34/147/155/233/339, 34/147/158, 34/147/158/182/233, 34/147/158/182/249/271, 34/147/182, 34/147/182/220, 34/147/182/220/230/249/315/339, 34/147/182/220/230/339, 34/147/182/220/271/315, 34/147/182/233/271/339, 34/147/182/249/307/315/339, 34/147/182/315, 34/147/182/345, 34/147/220/271, 34/147/230/273/315/345, 34/147/233, 34/147/249, 34/147/315/339, 34/158/182/315/339/345, 34/158/220, 34/158/307, 34/182, 34/182/230/315, 34/182/307/339, 34/182/345, 34/220, 34/220/307, 34/220/307/345, 34/220/315/339, 34/220/339, 34/233, 34/271/339, 34/315/345, 34/339, 48/78/147/158/182/220/230/307, 48/78/147/158/182/230/249/271/315, 48/78/147/158/233/249, 48/78/147/182/220/233/249/339/345, 48/78/147/182/220/315, 48/78/147/182/230/233/249, 48/78/158/182/220/233/249, 48/78/158/230/339, 48/78/233/315/339, 48/147/158/182/220/230/249/271/307/315/339, 48/147/158/182/220/249/307/339, 48/147/158/182/220/315, 48/147/158/182/230/233, 48/147/158/182/233/345, 48/147/158/233, 48/147/158/307/345, 48/147/233, 48/147/233/345, 48/147/271/307/339, 48/158/182/230/233/249, 48/182, 48/182/307/315, 48/339, 78/133/147/158/182/220/271/339, 78/135/182/233/249/315/345, 78/147/158/182, 78/147/158/182/230/249, 78/147/158/182/233/271/307/345, 78/147/158/182/339/345, 78/147/158/220/230/233/249/271/307/315/345, 78/147/158/249/307/315, 78/147/182/230/233/249, 78/147/182/249/307, 78/147/182/339/345, 78/147/230/307, 78/147/233, 78/147/249/271/339, 78/158/182, 78/158/182/233/271/315, 78/158/182/307/315/345, 78/182/220/339, 78/182/271/315/339, 78/233, 78/339, 133/135/307/315, 133/220/233/271, 133/307, 147, 147/158/182/220/233, 147/158/182/230/233/249/271/339, 147/158/182/233/249, 147/158/182/233/271/307/339, 147/158/182/233/307/339, 147/158/182/233/315/345, 147/158/182/271/315, 147/158/182/315, 147/158/220/230/233/249/345, 147/158/220/249/315, 147/158/233/249, 147/182/220/233/345, 147/182/230/307/315/339, 147/182/233, 147/182/233/249, 147/182/249/271/307, 147/182/345, 147/220, 147/232/233/271/315/339, 147/233/345, 147/249, 147/339, 158/182/220/230/249/307/339, 158/233, 158/307, 158/315, 158/315/339, 182, 182/220/345, 182/230, 182/230/233, 182/345, 220, 220/249, 220/307/339, 233, 233/271, 233/315, 249, 249/315/339, 271/339, 315, and 339. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2164 and one or more residue differences or residue difference sets as compared to SEQ ID NO: 2164, selected from 34A, 34A/48L/78F/133S/147Y/182M, 34A/48L/78F/147Y/158R, 34A/48L/78F/147Y/182M/220V/233G/249T/307G/315V/339Q, 34A/48L/78F/158R/182G/233R/315V/345K, 34A/48L/78F/158R/182M/220V/249T/307G, 34A/48L/78F/182G/220V/230L/315V, 34A/48L/78F/182G/220V/233R, 34A/48L/133S/158R/182G/230L/233G/271H/345K, 34A/48L/147Y, 34A/48L/147Y/158R/182M/220V/233R/307G, 34A/48L/147Y/182G/230L/233G/249T/307G, 34A/48L/147Y/271H, 34A/48L/182G/233G/249T, 34A/48L/339Q, 34A/78F, 34A/78F/84G/147Y/158R/182M/220V, 34A/78F/84G/158R/230L, 34A/78F/147Y/182G/233R/249T/315V, 34A/78F/147Y/182M/220V/249T, 34A/78F/147Y/182M/233R/271H/339Q, 34A/78F/158R, 34A/78F/158R/182M/315V/345K, 34A/78F/158R/249T, 34A/78F/182M/233R/307G, 34A/78F/204T/220V/339Q, 34A/78F/220V/271H, 34A/78F/220V/307G/339Q, 34A/78F/315V, 34A/133S/147Y/158R/230L/233G/249T, 34A/147Y, 34A/147Y/155D/233G/339Q, 34A/147Y/158R, 34A/147Y/158R/182G/249T/271H, 34A/147Y/158R/182M/233R, 34A/147Y/182G/220V, 34A/147Y/182G/233G/271H/339Q, 34A/147Y/182G/345K, 34A/147Y/182M, 34A/147Y/182M/220V/230L/249T/315V/339Q, 34A/147Y/182M/220V/230L/339Q, 34A/147Y/182M/220V/271H/315V, 34A/147Y/182M/249T/307G/315V/339Q, 34A/147Y/182M/315V, 34A/147Y/220V/271H, 34A/147Y/230L/273N/315V/345K, 34A/147Y/233R, 34A/147Y/249T, 34A/147Y/315V/339Q, 34A/158R/182G/315V/339Q/345K, 34A/158R/220V, 34A/158R/307G, 34A/182G/307G/339Q, 34A/182G/345K, 34A/182M, 34A/182M/230L/315V, 34A/220V, 34A/220V/307G, 34A/220V/307G/345K, 34A/220V/315V/339Q, 34A/220V/339Q, 34A/233G, 34A/271H/339Q, 34A/315V/345K, 34A/339Q, 48L/78F/147Y/158M/182G/230L/249T/271H/315V, 48L/78F/147Y/158R/182M/220V/230L/307G, 48L/78F/147Y/158R/233G/249T, 48L/78F/147Y/182G/230L/233G/249T, 48L/78F/147Y/182M/220V/233G/249T/339Q/345K, 48L/

78F/147Y/182M/220V/315V, 48L/78F/158R/182G/220V/233G/249T, 48L/78F/158R/230L/339Q, 48L/78F/233R/315V/339Q, 48L/147Y/158R/182G/220V/249T/307G/339Q, 48L/147Y/158R/182G/230L/233G, 48L/147Y/158R/182M/220V/230L/249T/271H/307G/315V/339Q, 48L/147Y/158R/182M/220V/315V, 48L/147Y/158R/182M/233G/345K, 48L/147Y/158R/233G, 48L/147Y/158R/307G/345K, 48L/147Y/233G/345K, 48L/147Y/233R, 48L/147Y/271H/307G/339Q, 48L/158R/182M/230L/233R/249T, 48L/182G/307G/315V, 48L/182M, 48L/339Q, 78F/133S/147Y/158R/182G/220V/271H/339Q, 78F/135A/182M/233R/249T/315V/345K, 78F/147Y/158R/182G/230L/249T, 78F/147Y/158R/182G/339Q/345K, 78F/147Y/158R/182M, 78F/147Y/158R/182M/233R/271H/307G/345K, 78F/147Y/158R/220V/230L/233G/249T/271H/307G/315V/345K, 78F/147Y/158R/249T/307G/315V, 78F/147Y/182G/249T/307G, 78F/147Y/182M/230L/233G/249T, 78F/147Y/182M/339Q/345K, 78F/147Y/230L/307G, 78F/147Y/233G, 78F/147Y/249T/271H/339Q, 78F/158R/182M, 78F/158R/182M/233R/271H/315V, 78F/158R/182M/307G/315V/345K, 78F/182G/271H/315V/339Q, 78F/182M/220V/339Q, 78F/233R, 78F/339Q, 133S/135A/307G/315V, 133S/220V/233G/271H, 133S/307G, 147Y, 147Y/158R/182G/220V/233G, 147Y/158R/182G/233G/271H/307G/339Q, 147Y/158R/182G/233G/307G/339Q, 147Y/158R/182M/230L/233R/249T/271H/339Q, 147Y/158R/182M/233R/249T, 147Y/158R/182M/233R/315V/345K, 147Y/158R/182M/271H/315V, 147Y/158R/182M/315V, 147Y/158R/220V/230L/233R/249T/345K, 147Y/158R/220V/249T/315V, 147Y/158R/233G/249T, 147Y/182G/233R, 147Y/182M/220V/233R/345K, 147Y/182M/230L/307G/315V/339Q, 147Y/182M/233G/249T, 147Y/182M/249T/271H/307G, 147Y/182M/345K, 147Y/220V, 147Y/232N/233G/271H/315V/339Q, 147Y/233R/345K, 147Y/249T, 147Y/339Q, 158R/182G/220V/230L/249T/307G/339Q, 158R/233R, 158R/307G, 158R/315V, 158R/315V/339Q, 182G, 182G/230L/233R, 182G/345K, 182M/220V/345K, 182M/230L, 220V, 220V/249T, 220V/307G/339Q, 233G/315V, 233R, 233R/271H, 249T, 249T/315V/339Q, 271H/339Q, 315V, and 339Q. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2164 and one or more residue differences or residue difference sets as compared to SEQ ID NO: 2164, selected from: S34A, S34A/F48L/L78F/T133S/F147Y/R182M, S34A/F48L/L78F/F147Y/K158R, S34A/F48L/L78F/F147Y/R182M/M220V/P233G/K249T/A307G/I315V/E339Q, S34A/F48L/L78F/K158R/R182G/P233R/I315V/R345K, S34A/F48L/L78F/K158R/R182M/M220V/K249T/A307G, S34A/F48L/L78F/R182G/M220V/N230L/I315V, S34A/F48L/L78F/R182G/M220V/P233R, S34A/F48L/T133S/K158R/R182G/N230L/P233G/R271H/R345K, S34A/F48L/F147Y, S34A/F48L/F147Y/K158R/R182M/M220V/P233R/A307G, S34A/F48L/F147Y/R182G/N230L/P233G/K249T/A307G, S34A/F48L/F147Y/R271H, S34A/F48L/R182G/P233G/K249T, S34A/F48L/E339Q, S34A/L78F, S34A/L78F/E84G/F147Y/K158R/R182M/M220V, S34A/L78F/E84G/K158R/N230L, S34A/L78F/F147Y/R182G/P233R/K249T/I315V, S34A/L78F/F147Y/R182M/M220V/K249T, S34A/L78F/F147Y/R182M/P233R/R271H/E339Q, S34A/L78F/K158R, S34A/L78F/K158R/R182M/I315V/R345K, S34A/L78F/K158R/K249T, S34A/L78F/R182M/P233R/A307G, S34A/L78F/P204T/M220V/E339Q, S34A/L78F/M220V/R271H, S34A/L78F/M220V/A307G/E339Q, S34A/L78F/I315V, S34A/T133S/F147Y/K158R/N230L/P233G/K249T, S34A/F147Y, S34A/F147Y/E155D/P233G/E339Q, S34A/F147Y/K158R, S34A/F147Y/K158R/R182G/K249T/R271H, S34A/F147Y/K158R/R182M/P233R, S34A/F147Y/R182G/M220V, S34A/F147Y/R182G/P233G/R271H/E339Q, S34A/F147Y/R182G/R345K, S34A/F147Y/R182M, S34A/F147Y/R182M/M220V/N230L/K249T/I315V/E339Q, S34A/F147Y/R182M/M220V/N230L/E339Q, S34A/F147Y/R182M/M220V/R271H/I315V, S34A/F147Y/R182M/K249T/A307G/I315V/E339Q, S34A/F147Y/R182M/I315V, S34A/F147Y/M220V/R271H, S34A/F147Y/N230L/I273N/I315V/R345K, S34A/F147Y/P233R, S34A/F147Y/K249T, S34A/F147Y/I315V/E339Q, S34A/K158R/R182G/I315V/E339Q/R345K, S34A/K158R/M220V, S34A/K158R/A307G, S34A/R182G/A307G/E339Q, S34A/R182G/R345K, S34A/R182M, S34A/R182M/N230L/I315V, S34A/M220V, S34A/M220V/A307G, S34A/M220V/A307G/R345K, S34A/M220V/I315V/E339Q, S34A/M220V/E339Q, S34A/P233G, S34A/R271H/E339Q, S34A/I315V/R345K, S34A/E339Q, F48L/L78F/F147Y/K158M/R182G/N230L/K249T/R271H/I315V, F48L/L78F/F147Y/K158R/R182M/M220V/N230L/A307G, F48L/L78F/F147Y/K158R/P233G/K249T, F48L/L78F/F147Y/R182G/N230L/P233G/K249T, F48L/L78F/F147Y/R182M/M220V/P233G/K249T/E339Q/R345K, F48L/L78F/F147Y/R182M/M220V/I315V, F48L/L78F/K158R/R182G/M220V/P233G/K249T, F48L/L78F/K158R/N230L/E339Q, F48L/L78F/P233R/I315V/E339Q, F48L/F147Y/K158R/R182G/M220V/K249T/A307G/E339Q, F48L/F147Y/K158R/R182G/N230L/P233G, F48L/F147Y/K158R/R182M/M220V/N230L/K249T/R271H/A307G/I315V/E339Q, F48L/F147Y/K158R/R182M/M220V/I315V, F48L/F147Y/K158R/R182M/P233G/R345K, F48L/F147Y/K158R/P233G, F48L/F147Y/K158R/A307G/R345K, F48L/F147Y/P233G/R345K, F48L/F147Y/P233R, F48L/F147Y/R271H/A307G/E339Q, F48L/K158R/R182M/N230L/P233R/K249T, F48L/R182G/A307G/I315V, F48L/R182M, F48L/E339Q, L78F/T133S/F147Y/K158R/R182G/M220V/R271H/E339Q, L78F/V135A/R182M/P233R/K249T/I315V/R345K, L78F/F147Y/K158R/R182G/N230L/K249T, L78F/F147Y/K158R/R182G/E339Q/R345K, L78F/F147Y/K158R/R182M, L78F/F147Y/K158R/R182M/P233R/R271H/A307G/R345K, L78F/F147Y/K158R/M220V/N230L/P233G/K249T/R271H/A307G/I315V/R345K, L78F/F147Y/K158R/K249T/A307G/I315V, L78F/F147Y/R182G/K249T/A307G, L78F/F147Y/R182M/N230L/P233G/K249T, L78F/F147Y/R182M/E339Q/R345K, L78F/F147Y/N230L/A307G, L78F/F147Y/P233G, L78F/F147Y/K249T/R271H/E339Q, L78F/K158R/R182M, L78F/K158R/R182M/P233R/R271H/I315V, L78F/K158R/R182M/A307G/I315V/R345K, L78F/R182G/R271H/I315V/E339Q, L78F/R182M/M220V/E339Q, L78F/P233R, L78F/E339Q, T133S/V135A/A307G/I315V, T133S/M220V/P233G/R271H, T133S/A307G, F147Y, F147Y/K158R/R182G/M220V/P233G, F147Y/K158R/R182G/P233G/R271H/A307G/E339Q, F147Y/K158R/R182G/P233G/A307G/E339Q, F147Y/K158R/R182M/N230L/P233R/K249T/R271H/E339Q, F147Y/K158R/R182M/P233R/K249T, F147Y/K158R/R182M/P233R/I315V/R345K, F147Y/K158R/R182M/R271H/I315V, F147Y/K158R/R182M/I315V, F147Y/K158R/M220V/N230L/P233R/K249T/R345K, F147Y/K158R/M220V/K249T/I315V, F147Y/K158R/P233G/K249T, F147Y/R182G/P233R, F147Y/R182M/M220V/P233R/R345K, F147Y/R182M/N230L/A307G/I315V/E339Q, F147Y/R182M/P233G/K249T, F147Y/R182M/K249T/R271H/A307G, F147Y/

R182M/R345K, F147Y/M220V, F147Y/G232N/P233G/R271H/I315V/E339Q, F147Y/P233R/R345K, F147Y/K249T, F147Y/E339Q, K158R/R182G/M220V/N230L/K249T/A307G/E339Q, K158R/P233R, K158R/A307G, K158R/I315V, K158R/I315V/E339Q, R182G, R182G/N230L/P233R, R182G/R345K, R182M/M220V/R345K, R182M/N230L, M220V, M220V/K249T, M220V/A307G/E339Q, P233G/I315V, P233R, P233R/R271H, K249T, K249T/I315V/E339Q, R271H/E339Q, I315V, and E339Q.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2666 and one or more residue differences or residue difference sets as compared to SEQ ID NO: 2666, selected from: 162, 167, 259, 272, 273, 345, 346, and 365. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2666 and one or more residue differences or residue difference sets as compared to SEQ ID NO: 2666, selected from 162T, 167A, 259R, 272M, 273E, 345C, 346W, and 365G. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2666 and one or more residue differences or residue difference sets as compared to SEQ ID NO: 2666, selected from: S162T, K167A, K259R, K272M, I273E, R345C, R346W, and K365G.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2666 and one or more residue differences or residue difference sets as compared to SEQ ID NO: 2666, selected from: 260, 272, 273, 280, 345, and 346. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2666 and one or more residue differences or residue difference sets as compared to SEQ ID NO: 2666, selected from 260P, 272M, 273E, 280S, 345C, 346Q, and 346W. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2666 and one or more residue differences or residue difference sets as compared to SEQ ID NO: 2666, selected from: E260P, K272M, I273E, Q280S, R345C, R346Q, and R346W.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2666 and one or more residue differences or residue difference sets as compared to SEQ ID NO: 2666, selected from: 167, 170, 259, 260, 272, 325, 346, 365, 367, 368, 371, and 373. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2666 and one or more residue differences or residue difference sets as compared to SEQ ID NO: 2666, selected from 167R, 170R, 259R, 260P, 272G, 272M, 325S, 346Q, 365S, 367G, 368S, 371P, and 373M. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2666 and one or more residue differences or residue difference sets as compared to SEQ ID NO: 2666, selected from: K167R, K170R, K259R, E260P, K272G, K272M, E325S, R346Q, K365S, R367G, I368S, K371P, and G373M.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2666 and one or more residue differences or residue difference sets as compared to SEQ ID NO: 2666, selected from: 162, 259, 272, 273, 325, 345, 346, 367, and 373. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2666 and one or more residue differences or residue difference sets as compared to SEQ ID NO: 2666, selected from 162T, 259R, 272G, 272M, 273E, 325S, 345C, 346Q, 346W, 367G, and 373M. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2666 and one or more residue differences or residue difference sets as compared to SEQ ID NO: 2666, selected from: S162T, K259R, K272G, K272M, I273E, E325S, R345C, R346Q, R346W, R367G, and G373M.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2666 and one or more residue differences or residue difference sets as compared to SEQ ID NO: 2666, selected from: 136, 162, 164, 167, 170, 200/271, 259, 262, 267, 268, 272, 278, 284, 321, 324, 327, 328, 345, 346, 352, 353, 355, 364, 365, 366, 368, 370, 371, and 373. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2666 and one or more residue differences or residue difference sets as compared to SEQ ID NO: 2666, selected from 136W, 162C, 162E, 162F, 162H, 162T, 162V, 164A, 164S, 164W, 167A, 170T, 200C/271G, 259V, 262S, 267E, 286I, 268V, 272G, 272M, 278D, 284S, 321V, 324W, 327F, 328S, 345C, 346A, 346I, 346Q, 346S, 346V, 346W, 352C, 352V, 353H, 355L, 364K, 365G, 365S, 366E, 366R, 368V, 370Y, 371P, 373M, and 373S. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2666 and one or more residue differences or residue difference sets as compared to SEQ ID NO: 2666, selected from: F136W, S162C, S162E, S162F, S162H, S162T, S162V, K164A, K164S, K164W, K167A, K170T, R200C/H271G, K259V, T262S, Q267E, L268I, L268V, K272G, K272M, N278D, A284S, I321V, F324W, Y327F, A328S, R345C, R346A, R346I, R346Q, R346S, R346V, R346W, R352C, R352V, G353H, I355L, L364K, K365G, K365S, K366E, K366R, I368V, L370Y, K371P, G373M, and G373S.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2666 and one or more residue differences or residue difference sets as compared to SEQ ID NO: 2666, selected from: 20, 20/100, 20/100/104/111/242, 20/100/104/120/197/367, 20/100/104/197/203/242/292, 20/100/104/203/350/353, 20/100/111, 20/100/120/197/232/235/315/366/367, 20/100/197/292/315, 20/100/203, 20/100/232/292/366/367, 20/100/235/315/367, 20/104/111/120/203, 20/120/197/292, 20/120/235, 20/292, 100, 100/111, 100/120/197/242, 104/120/232/353, and 111/197/242. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2666 and one or more residue differences or residue difference sets as compared to SEQ ID NO: 2666, selected from 20E/100D/120I/197E/232M/235M/315V/3665/367K, 20K, 20K/100D, 20K/100D/104L/203V/350L/353D, 20K/100D/111R, 20K/100D/232M/292K/366S/367K, 20K/120I/197E/292K, 20K/120I/235M, 20K/292K, 20R/100D/104L/111R/242R, 20R/100D/104L/120I/197E/367K, 20R/100D/104L/197E/203V/242R/292K, 20R/100D/197E/292K/315V, 20R/100D/203V, 20R/100D/235M/315V/367K, 20R/104L/111R/120I/203V, 100D, 100D/111R, 100D/120I/197E/242R, 104L/120I/232M/353D, and 111R/197E/242R. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2666 and one or more residue differences or residue difference sets as compared to SEQ ID NO: 2666, selected from: G20E/Q100D/V120I/N197E/G232M/E235M/I315V/K366S/R367K, G20K, G20K/Q100D, G20K/Q100D/V104L/L203V/E350L/G353D, G20K/Q100D/E111R, G20K/Q100D/G232M/G292K/K366S/R367K, G20K/V120I/N197E/G292K, G20K/V120I/E235M, G20K/G292K, G20R/Q100D/V104L/E111R/K242R, G20R/Q100D/V104L/V120I/N197E/R367K, G20R/Q100D/V104L/N197E/L203V/K242R/G292K, G20R/Q100D/N197E/G292K/I315V, G20R/Q100D/L203V, G20R/Q100D/E235M/I315V/R367K, G20R/V104L/E111R/V120I/L203V, Q100D, Q100D/E111R, Q100D/V1201/N197E/K242R, V104L/V120I/G232M/G353D, and E111R/N197E/K242R.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2794 and one or more residue differences or residue difference sets as compared to SEQ ID NO: 2794, selected from: 200, 201, 202, 203, 226, 229, 230, 234, 235, 236, 237, 238, 324, 326, 342, 344, 352, 355, 360, 366, 369, 371, 373, 374, 377, 378, 383, 388, and 390. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2794 and one or more residue differences or residue difference sets as compared to SEQ ID NO: 2794, selected from 200A, 200M, 201R, 202V, 203A, 226L, 226M, 229S, 230T, 234H, 234R, 235T, 236L, 237C, 237E, 237T, 238R, 324A, 324T, 326S, 342L, 342V, 344M, 352L, 352V, 355L, 360G, 366E, 366Q, 366R, 369L, 369Y, 371A, 373A, 373S, 373T, 374N, 377D, 378V, 383N, 388A, 388L, and 390Y. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2794 and one or more residue differences or residue difference sets as compared to SEQ ID NO: 2794, selected from: R200A, R200M, T201R, F202V, L203A, F226L, F226M, T229S, N230T, K234H, K234R, E235T, D236L, D237C, D237E, D237T, E238R, F324A, F324T, Q326S, R342L, R342V, L344M, R352L, R352V, I355L, A360G, K366E, K366Q, K366R, F369L, F369Y, K371A, G373A, G373S, G373T, S374N, E377D, I378V, G383N, E388A, E388L, and W390Y.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2794 and one or more residue differences or residue difference sets as compared to SEQ ID NO: 2794, selected from: 200, 203, 226, 234, 237, 342, 350, 360, 366, 369, 373, 377, 378, 380, and 390. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2794 and one or more residue differences or residue difference sets as compared to SEQ ID NO: 2794, selected from 200A, 200G, 200M, 203A, 226L, 234R, 237C, 237E, 237R, 342L, 342V, 3501, 360R, 366E, 366Q, 369Y, 373A, 377D, 378V, 380M, and 390Y. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2794 and one or more residue differences or residue difference sets as compared to SEQ ID NO: 2794, selected from: R200A, R200G, R200M, L203A, F226L, K234R, D237C, D237E, D237R, R342L, R342V, E3501, A360R, K366E, K366Q, F369Y, G373A, E377D, I378V, A380M, and W390Y.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2794 and one or more residue differences or residue difference sets as compared to SEQ ID NO: 2794, selected from: 200, 201, 203, 207, 226, 230, 233, 234, 235, 322, 342, 344, 352, 355, 360, 366, 371, 373, 374, 378, and 387. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2794 and one or more residue differences or residue difference sets as compared to SEQ ID NO: 2794, selected from 200A, 200G, 200M, 201R, 203A, 207A, 207E, 226L, 230Y, 233S, 234H, 234R, 235T, 322C, 322P, 342L, 342V, 344M, 344T, 352L, 352V, 355L, 360G, 366E, 366Q, 371A, 371S, 373A, 373S, 374D, 378V, and 387L. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2794 and one or more residue differences or residue difference sets as compared to SEQ ID NO: 2794, selected from: R200A, R200G, R200M, T201R, L203A, L207A, L207E, F226L, N230Y, R233S, K234H, K234R, E235T, T322C, T322P, R342L, R342V, L344M, L344T, R352L, R352V, I355L, A360G, K366E, K366Q, K371A, K371S, G373A, G373S, S374D, I378V, and V387L.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2794 and one or more residue differences or residue difference sets as compared to SEQ ID NO: 2794, selected from: 15, 200, 202, 203, 205, 206, 207, 226, 229, 230, 231, 233, 234, 237, 321, 324, 326, 327, 330, 342, 344, 349, 352, 353, 360, 366, 369, 371, 373, 374, 378, 380, 386, 387, 388, and 390. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2794 and one or more residue differences or residue difference sets as compared to SEQ ID NO: 2794, selected from 15G, 200A, 200G, 200M, 200T, 200W, 202V, 203A, 205G, 206G, 207A, 207E, 207G, 226L, 226M, 229S, 230G, 230T, 231G, 233S, 234H, 234R, 234S, 237C, 237E, 237T, 321C, 324T, 326S, 327R, 330G, 342L, 344M, 344T, 349M, 349T, 352L, 353A, 353D, 353N, 360R, 366E, 369Y, 371A, 373A, 373T, 374D, 374N, 378V, 380M, 386F, 387L, 388L, 388Q, and 390Y. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2794 and one or more residue differences or residue difference sets as compared to SEQ ID NO: 2794, selected from: S15G, R200A, R200G, R200M, R200T, R200W, F202V, L203A, D205G, A206G, L207A, L207E, L207G, F226L, F226M, T229S, N230G, N230T, P231G, R233S, K234H, K234R, K234S, D237C, D237E, D237T, I321C, F324T, Q326S, Y327R, A330G, R342L, L344M, L344T, E349M, E349T, R352L, G353A, G353D, G353N, A360R, K366E, F369Y, K371A, G373A, G373T, S374D, S374N, I378V, A380M, Y386F, V387L, E388L, E388Q, and W390Y.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2794 and one or more residue differences or residue difference sets as compared to SEQ ID NO: 2794, selected from: 55/80/174/268/355/366, 55/80/268/315/366, 55/80/268/346, 55/111/156/268/315/324/327/366/373, 55/111/268/346/355, 55/111/268/355/366, 55/111/315/355/373, 55/268, 55/268/315/346, 55/268/324/366, 55/268/346/355, 62/66/69/143/338/353, 62/66/100/101/104/203/235/338, 62/69/80/101/104/143/235/338, 62/203/211/235/338/350, 66/69/143/235/338, 69/80/203/211/278/338, 80/111/268/324/327/346/366/373, 80/111/355/366, 80/143/203/211/338, 80/268/315/346/355, 80/268/327/346/366, 80/268/346, 80/315/346/364/373, 80/346/366, 100/101/211/278/338/350/353, 111/268, 268, 268/315/327/346, 268/315/346, 268/315/346/366, 268/315/355, 268/324, 268/324/327/346, 268/327/346, 268/346, 268/346/355, 268/355/366, 315/324/327/355/366, 324/346/355/366, and 327/346. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2794 and one or more residue differences or residue difference sets as compared to SEQ ID NO: 2794, selected from 55L/80S/174Q/268I/355L/366E, 55L/80S/268I/315V/366E, 55L/80S/268V/346V, 55L/111R/156A/268V/315V/324W/327F/366E/3735, 55L/111R/268V/346I/355L, 55L/111R/268V/355L/366E, 55L/111R/315V/355L/373S, 55L/268I/346V/355L, 55L/268V, 55L/268V/315V/346V, 55L/268V/324W/366E, 62E/66Q/69H/143S/338G/353D, 62E/66Q/100D/101C/104L/203V/235M/338G, 62E/69H/80S/101C/104L/143S/235M/338G, 62E/203V/211A/235M/338G/350L, 66Q/69H/143S/235M/338G, 69H/80S/203V/211A/278H/338G, 80S/111R/268I/324W/327F/346I/366E/373S, 80S/111R/355L/366E, 80S/143S/203V/211A/338G, 80S/268I/315V/346I/355L, 80S/268V/327F/346I/366E, 80S/268V/346I, 80S/268V/346V, 80S/315V/346A/364P/373S, 80S/346A/366E, 100D/101C/211A/278H/338G/350L/353D, 111R/268I, 268I, 268I/315V/346V, 268I/315V/355L, 268I/324W, 268I/324W/327F/346V, 268V/315V/327F/346V, 268V/315V/346A, 268V/315V/346I, 268V/315V/346V/366E, 268V/324W/327F/346I, 268V/327F/346A, 268V/346A/355L, 268V/346I, 268V/346V, 268V/355L/366E, 315V/324W/327F/355L/366E, 324W/346I/355L/366E, and 327F/346A. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2794 and one or more residue differences or residue difference sets as compared to SEQ ID NO: 2794, selected from: M55L/Y80S/L174Q/L268I/I355L/K366E, M55L/Y80S/L268I/I315V/K366E, M55L/Y80S/L268V/R346V, M55L/E111R/E156A/L268V/I315V/F324W/Y327F/K366E/G373S, M55L/E111R/L268V/R346I/I355L, M55L/E111R/L268V/I355L/K366E, M55L/E111R/I315V/I355L/G373S, M55L/L268I/R346V/I355L, M55L/L268V, M55L/L268V/I315V/R346V, M55L/L268V/F324W/K366E, K62E/I66Q/L69H/A143S/K338G/G353D, K62E/I66Q/Q100D/V101C/V104L/L203V/E235M/K338G, K62E/L69H/Y80S/V101C/V104L/A143S/E235M/K338G, K62E/L203V/T211A/E235M/K338G/E350L, I66Q/L69H/A143S/E235M/K338G, L69H/Y80S/L203V/T211A/N278H/K338G, Y80S/E111R/L286I/F324W/Y327F/R346I/K366E/G373S, Y80S/E111R/I355L/K366E, Y80S/A143S/L203V/T211A/K338G, Y80S/L268I/I315V/R346I/I355L, Y80S/L268V/Y327F/R346I/K366E, Y80S/L268V/R346I, Y80S/L268V/R346V, Y80S/I315V/R346A/L364P/G373S, Y80S/R346A/K366E, Q100D/V101C/T211A/N278H/K338G/E350L/G353D, E111R/L286I, L286I, L286I/I315V/R346V, L268I/I315V/I355L, L268I/F324W, L268I/F324W/Y327F/R346V, L268V/I315V/Y327F/R346V, L268V/I315V/R346A, L268V/I315V/R346I, L268V/I315V/R346V/K366E, L268V/F324W/Y327F/R346I, L268V/Y327F/R346A, L268V/R346A/I355L, L268V/R346I, L268V/R346V, L268V/I355L/K366E, I315V/F324W/Y327F/I355L/K366E, F324W/R346I/I355L/K366E, and Y327F/R346A.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2978 and one or more residue differences or residue difference sets as compared to SEQ ID NO: 2978, selected from: 62/69/100/235/268/346, 62/69/353, 62/111/235/315/355, 62/111/235/324/346, 62/235/268/327/346/350/353/355, 62/235/346/350/355, 62/315/327/353, 62/323/346/353/355, 66, 66/100/235/315/327/353/355, 66/111/346/353/355, 66/235/268/346, 66/235/346, 66/235/373, 69, 69/100, 69/100/111/298/353/355, 69/100/235, 69/100/353/366, 69/111/235, 69/111/235/300/353/355, 69/111/235/315, 69/235/315, 69/235/353, 69/268, 69/268/324/327/353/355, 69/268/346, 69/268/346/353, 69/315/353, 69/324/327/346, 69/324/346/350, 69/324/353, 69/353/355, 100, 100/111/353, 100/235/268/315/346, 100/235/268/346/355, 100/235/268/366/373, 100/235/346/350/353, 100/268/346, 100/268/366, 111/235/268/327/346, 111/235/268/346, 111/235/346/350, 111/268, 111/327, 232/346/350/355, 235/268/327/346, 235/268/346, 235/315, 235/315/353/355, 235/346, 235/346/350, 235/353, 235/353/355, 268/346, 268/346/350/353/355, 268/353, 315/327/346, 324/327/346, 324/346/350, 324/355, 327/346, 346, and 353/355. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2978 and one or more residue differences or residue difference sets as compared to SEQ ID NO: 2978, selected from 62E/69H/100D/235M/268V/346I, 62E/69H/353D, 62E/111R/235M/315V/355L, 62E/111R/235M/324W/346I, 62E/235M/268V/327F/346I/350L/353D/355L, 62E/235M/346V/350L/355L, 62E/315V/327F/353D, 62E/323S/346I/353D/355L, 66Q, 66Q/100D/235M/315V/327F/353D/355L, 66Q/111R/346V/353D/355L, 66Q/235M/268V/346I, 66Q/235M/346S, 66Q/235M/373S, 69H, 69H/100D, 69H/100D/111R/298I/353D/355L, 69H/100D/235M, 69H/100D/353D/366E, 69H/111R/235M, 69H/111R/235M/300K/353D/355L, 69H/111R/235M/315V, 69H/235M/315V, 69H/235M/353D, 69H/268V, 69H/268V/324W/327F/353D/355L, 69H/268V/346I, 69H/268V/346V/353D, 69H/315V/353D, 69H/324W/327F/346I, 69H/324W/346I/350L, 69H/324W/353D, 69H/353D/355L, 100D, 100D/111R/353D, 100D/235M/268V/315V/346I, 100D/235M/268V/346V/355L, 100D/235M/268V/366E/3735, 100D/235M/346I/350L/353D, 100D/268V/346I, 100D/268V/366E, 111R/235M/268V/327F/346V, 111R/235M/268V/346I, 111R/235M/346V/350L, 111R/268V, 111R/327F, 232D/346I/350L/355L, 235M/268V/327F/346V, 235M/268V/346I, 235M/315V, 235M/315V/353D/355L, 235M/346I, 235M/346V, 235M/346V/350L, 235M/353D, 235M/353D/355L, 268V/346I, 268V/346I/350L/353D/355L, 268V/353D, 315V/327F/346I, 324W/327F/346I, 324W/346I/350L, 324W/355L, 327F/346V, 346I, and 353D/355L. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 2978 and one or more residue differences or residue difference sets as compared to SEQ ID NO: 2978, selected from: K62E/L69H/Q100D/E235M/L268V/R346I, K62E/L69H/G353D, K62E/E111R/E235M/I315V/I355L, K62E/E111R/E235M/F324W/R346I, K62E/E235M/L268V/Y327F/R346I/E350L/G353D/I355L, K62E/E235M/R346V/E350L/I355L, K62E/I315V/Y327F/G353D, K62E/P323S/R346I/G353D/I355L, I66Q, I66Q/Q100D/E235M/I315V/Y327F/G353D/I355L, I66Q/E111R/R346V/G353D/I355L, I66Q/E235M/L268V/R346I, I66Q/E235M/R346S, I66Q/E235M/G373S, L69H, L69H/Q100D, L69H/Q100D/E111R/V298I/G353D/I355L, L69H/Q100D/E235M, L69H/Q100D/G353D/K366E, L69H/E111R/E235M, L69H/E111R/E235M/T300K/G353D/I355L, L69H/E111R/E235M/I315V, L69H/E235M/I315V, L69H/E235M/G353D, L69H/L268V, L69H/L268V/F324W/Y327F/G353D/I355L, L69H/L268V/R346I, L69H/L268V/R346V/G353D, L69H/I315V/G353D, L69H/F324W/Y327F/R346I, L69H/F324W/R346I/E350L, L69H/F324W/G353D, L69H/G353D/I355L, Q100D, Q100D/E111R/G353D, Q100D/E235M/L268V/I315V/R346I, Q100D/E235M/L268V/R346V/I355L, Q100D/E235M/L268V/K366E/G373S, Q100D/E235M/R346I/E350L/G353D, Q100D/L268V/R346I, Q100D/L268V/K366E, E111R/E235M/L268V/Y327F/R346V, E111R/E235M/L268V/R346I, E111R/E235M/R346V/E350L, E111R/L268V, E111R/Y327F, G232D/R346I/E350L/I355L, E235M/L268V/Y327F/R346V, E235M/L268V/R346I, E235M/I315V, E235M/I315V/G353D/I355L, E235M/R346I, E235M/R346V, E235M/R346V/E350L, E235M/G353D, E235M/G353D/I355L, L268V/R346I, L268V/R346I/E350L/G353D/I355L, L268V/G353D, I315V/Y327F/R346I, F324W/Y327F/R346I, F324W/R346I/E350L, F324W/I355L, Y327F/R346V, R346I, and G353D/I355L.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3074 and one or more residue differences or residue difference sets as compared to SEQ ID NO: 3074, selected from: 16, 17, 210, 234, 373, and 380. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3074 and one or more residue differences or residue difference sets as compared to SEQ ID NO: 3074, selected from 16M, 17R, 210L, 234A, 234Q, 373N, and 380S. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3074 and one or more residue differences or residue difference sets as compared to SEQ ID NO: 3074, selected from: N16M, T17R, I210L, K234A, K234Q, G373N, and A380S.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3074 and one or more residue differences or residue difference sets as compared to SEQ ID NO: 3074, selected from: 16, 17, 18, 20, 21, 22, 24, 27, 28, 29, 32, 38, 44, 48, 77, 78, 78/127, 79, 80, 103, 106, 111, 115, 117, 119, 210, 232, 238, 272, and 373. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3074 and one or more residue differences or residue difference sets as compared to SEQ ID NO: 3074, selected from 16M, 17G, 18L, 20A, 20G, 21N, 22C, 22P, 22Q, 24T, 27S, 28G, 29H, 29S, 32C, 32P, 38R, 44R, 44V, 481, 77L, 77V, 78L, 78L/127R, 79R, 80W, 103C, 103G, 103P, 103S, 106Q, 106R, 106Y, 111H, 111M, 111N, 111S, 111V, 115R, 117I, 119A, 210L, 232T, 238D, 272D, and 373N. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3074 and one or more residue differences or residue difference sets as compared to SEQ ID NO: 3074, selected from: N16M, T17G, P18L, K20A, K20G, E21N, V22C, V22P, V22Q, S24T, A27S, R28G, P29H, P29S, Q32C, Q32P, K38R, Y44R, Y44V, F481, 177L, I77V, F78L, F78L/K127R, K79R, S80W, D103C, D103G, D103P, D103S, E106Q, E106R, E106Y, E111H, E111M, E111N, E111S, E111V, S115R, V117I, E119A, I210L, G232T, E238D, K272D, and G373N.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3074 and one or more residue differences or residue difference sets as compared to SEQ ID NO: 3074, selected from: 111/226, 111/226/321/344/346/369/387, 162/367/371, 201/202, 201/202/272/360, 202/233, 202/235/360/367/371, 207/235/327/360/371, 226, 226/268, 226/321/369, 226/366, 226/366/369/387, 233/367/371, 233/371, and 367/371. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3074 and one or more residue differences or residue difference sets as compared to SEQ ID NO: 3074, selected from 111R/226L, 111R/226L/321C/344T/346I/369Y/387L, 162T/367G/3715, 201G/202V, 201G/202V/272G/360R, 202V/2335, 202V/235E/360R/367G/3715, 207A/235E/327Y/360R/3715, 226L, 226L/268V, 226L/321C/369Y, 226L/366E, 226L/366E/369Y/387L, 233S/367G/3715, 233S/371S, and 367G/371S. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3074 and one or more residue differences or residue difference sets as compared to SEQ ID NO: 3074, selected from: E111R/F226L, E111R/F226L/I321C/L344T/R346I/F369Y/V387L, S162T/R367G/K371S, T201G/F202V, T201G/F202V/K272G/A360R, F202V/R233S, F202V/M235E/A360R/R367G/K371S, L207A/M235E/F327Y/A360R/K371S, F226L, F226L/L268V, F226L/I321C/F369Y, F226L/K366E, F226L/K366E/F369Y/V387L, R233S/R367G/K371S, R233S/K371S, and R367G/K371S.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3302 and one or more residue differences or residue difference sets as compared to SEQ ID NO: 3302, selected from: 75, 75/233/344, 75/233/366, 104/200/207/237/344/373/387, 104/207/344/387, 106/182/203/226/235/342/346, 182/201/203/226/234/235/346, 182/201/203/226/234/342/346, 182/201/203/226/235, 182/201/203/226/235/346, 182/201/203/226/342/346, 182/201/203/268/346, 182/201/226/234/342/346, 182/201/226/235/346, 182/201/226/268/346, 182/201/342, 182/203/226, 182/226/234/268/342/346, 182/226/234/346, 182/226/235, 182/226/235/268/346, 182/226/235/342, 182/226/235/346, 182/226/268/342/346, 182/226/342, 182/226/346, 182/342/346, 201/203/226/234/342/346, 201/203/226/234/346, 201/203/226/268/342, 201/203/226/346, 201/203/268/346, 201/226/234/342/346, 201/226/234/346, 201/226/235/342, 201/226/268/346, 203/226, 203/226/234/235, 203/226/234/235/346, 203/226/235/268/346, 203/226/235/342, 203/226/235/346, 203/226/342/346, 203/226/346, 207, 207/233/237/344/387, 207/387, 226, 226/235/268, 226/235/268/342/346, 226/235/268/346, 226/235/342, 226/268/342, 226/268/342/346, 226/268/346, 226/342, 226/342/346, 226/346, 259/276/387, and 346. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3302 and one or more residue differences or residue difference sets as compared to SEQ ID NO: 3302, selected from 75V, 75V/233S/344T, 75V/233S/366E, 104L/200A/207E/237R/344M/373A/387L, 104L/207E/344T/387L, 106D/182G/203A/226L/235T/342L/346I, 182G/201R/203A/226L/234H/235T/346I, 182G/201R/203A/226L/234R/235T/346I, 182G/201R/203A/226L/234R/342V/346I, 182G/201R/203A/226L/235T, 182G/201R/203A/226L/235T/346I, 182G/201R/203A/226L/342V/346I, 182G/201R/203A/268I/346I, 182G/201R/226L/234H/342V/346I, 182G/201R/226L/235T/346I, 182G/201R/226L/268V/346I, 182G/201R/342V, 182G/203A/226L, 182G/226L/234R/268I/342V/346I, 182G/226L/234R/346I, 182G/226L/235T, 182G/226L/235T/268V/346I, 182G/226L/235T/342L, 182G/226L/235T/346I, 182G/226L/286I/342V/346I, 182G/226L/342V, 182G/226L/346I, 182G/342L/346I, 201R/203A/226L/234H/342V/346I, 201R/203A/226L/234H/346I, 201R/203A/226L/268I/342V, 201R/203A/226L/346I, 201R/203A/268I/346I, 201R/226L/234H/346I, 201R/226L/234R/342L/346I, 201R/226L/235T/342L, 201R/226L/268I/346I, 203A/226L, 203A/226L/234H/235T/346I, 203A/226L/234R/235T, 203A/226L/235T/268V/346I, 203A/226L/235T/342L, 203A/226L/235T/346I, 203A/226L/342V/346I, 203A/226L/346I, 207E, 207E/233S/237R/344M/387I, 207E/387L, 226L, 226L/235T/268I, 226L/235T/268V/342L/346I, 226L/235T/268V/346I, 226L/235T/342V, 226L/268I/342L/346I, 226L/268I/342V, 226L/268I/346I, 226L/268V/346I, 226L/342V, 226L/342V/346I, 226L/346I, 259R/276L/387L, and 346I. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3302 and one or more residue differences or residue difference sets as compared to SEQ ID NO: 3302, selected from: A75V, A75V/R233S/L344T, A75V/R233S/K366E, V104L/R200A/L207E/D237R/L344M/G373A/V387L, V104L/L207E/L344T/V387L, E106D/M182G/V203A/F226L/E235T/R342L/R346I, M182G/T201R/V203A/F226L/K234H/E235T/R346I, M182G/T201R/V203A/F226L/K234R/E235T/R346I, M182G/T201R/V203A/F226L/K234R/R342V/R346I, M182G/T201R/V203A/F226L/E235T, M182G/T201R/V203A/F226L/E235T/R346I, M182G/T201R/V203A/F226L/R342V/R346I, M182G/T201R/V203A/L268I/R346I, M182G/T201R/F226L/K234H/R342V/R346I, M182G/T201R/F226L/E235T/R346I, M182G/T201R/F226L/L268V/R346I, M182G/T201R/R342V, M182G/V203A/F226L, M182G/F226L/K234R/L268I/R342V/R346I, M182G/F226L/K234R/R346I, M182G/F226L/E235T, M182G/F226L/E235T/L268V/R346I, M182G/F226L/E235T/R342L, M182G/F226L/E235T/R346I, M182G/F226L/L268I/R342V/R346I, M182G/F226L/R342V, M182G/

F226L/R346I, M182G/R342L/R346I, T201R/V203A/F226L/K234H/R342V/R346I, T201R/V203A/F226L/K234H/R346I, T201R/V203A/F226L/L268I/R342V, T201R/V203A/F226L/R346I, T201R/V203A/L268I/R346I, T201R/F226L/K234H/R346I, T201R/F226L/K234R/R342L/R346I, T201R/F226L/E235T/R342L, T201R/F226L/L268I/R346I, V203A/F226L, V203A/F226L/K234H/E235T/R346I, V203A/F226L/K234R/E235T, V203A/F226L/E235T/L268V/R346I, V203A/F226L/E235T/R342L, V203A/F226L/E235T/R346I, V203A/F226L/R342V/R346I, V203A/F226L/R346I, L207E, L207E/R233S/D237R/L344M/V387I, L207E/V387L, F226L, F226L/E235T/L268I, F226L/E235T/L268V/R342L/R346I, F226L/E235T/L268V/R346I, F226L/E235T/R342V, F226L/L268I/R342L/R346I, F226L/L268I/R342V, F226L/L268I/R346I, F226L/L268V/R346I, F226L/R342V, F226L/R342V/R346I, F226L/R346I, K259R/M276L/V387L, and R346I.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3302 and one or more residue differences or residue difference sets as compared to SEQ ID NO: 3302, selected from: 75/233/344, 75/233/366, 104/200/207/237/344/373/387, 104/207/344/387, 182/201/203/226/234/235/346, 182/201/203/226/234/342/346, 182/201/203/226/235, 182/201/203/226/235/346, 182/201/203/226/342/346, 182/201/203/268/346, 182/201/226/234/342/346, 182/201/226/235/346, 182/201/226/268/346, 182/201/342, 182/203/226, 182/226/234/268/342/346, 182/226/234/346, 182/226/235, 182/226/235/268/346, 182/226/235/342, 182/226/235/346, 182/226/268/342/346, 182/226/342, 182/226/346, 201/203/226/234/342/346, 201/203/226/346, 201/203/268/342, 201/203/268/346, 201/226/234/342/346, 201/226/234/346, 201/226/235/342, 201/226/268/346, 203/226, 203/226/234/235, 203/226/235/268/346, 203/226/235/346, 203/226/346, 207, 207/233/237/344/387, 207/387, 226, 226/234/342, 226/235/268, 226/235/268/346, 226/235/346, 226/268/342, 226/268/346, 226/342/346, 226/346, and 259/276/387. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3302 and one or more residue differences or residue difference sets as compared to SEQ ID NO: 3302, selected from 75V/233S/344T, 75V/233S/366E, 104L/200A/207E/237R/344M/373A/387L, 104L/207E/344T/387L, 182G/201R/203A/226L/234H/235T/346I, 182G/201R/203A/226L/234R/235T/346I, 182G/201R/203A/226L/234R/342V/346I, 182G/201R/203A/226L/235T, 182G/201R/203A/226L/235T/346I, 182G/201R/203A/226L/342V/346I, 182G/201R/203A/268I/346I, 182G/201R/226L/234H/342V/346I, 182G/201R/226L/235T/346I, 182G/201R/226L/268V/346I, 182G/201R/342V, 182G/203A/226L, 182G/226L/234H/346I, 182G/226L/234R/268I/342V/346I, 182G/226L/234R/346I, 182G/226L/235T, 182G/226L/235T/268V/346I, 182G/226L/235T/342L, 182G/226L/235T/346I, 182G/226L/268I/342V/346I, 182G/226L/342V, 182G/226L/346I, 201R/203A/226L/234H/342V/346I, 201R/203A/226L/346I, 201R/203A/268I/346I, 201R/203A/268V/342V, 201R/226L/234H/346I, 201R/226L/234R/342L/346I, 201R/226L/235T/342L, 201R/226L/268I/346I, 203A/226L, 203A/226L/234R/235T, 203A/226L/235T/268V/346I, 203A/226L/235T/346I, 203A/226L/346I, 207E, 207E/233S/237R/344M/387I, 207E/387L, 226L, 226L/234R/342V, 226L/235T/268I, 226L/235T/268V/346I, 226L/235T/346I, 226L/268I/342V, 226L/268I/346I, 226L/268V/346I, 226L/342V/346I, 226L/346I, and 259R/276L/387L. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3302 and one or more residue differences or residue difference sets as compared to SEQ ID NO: 3302, selected from: A75V/R233S/L344T, A75V/R233S/K366E, V104L/R200A/L207E/D237R/L344M/G373A/V387L, V104L/L207E/L344T/V387L, M182G/T201R/V203A/F226L/K234H/E235T/R346I, M182G/T201R/V203A/F226L/K234R/E235T/R346I, M182G/T201R/V203A/F226L/K234R/R342V/R346I, M182G/T201R/V203A/F226L/E235T, M182G/T201R/V203A/F226L/E235T/R346I, M182G/T201R/V203A/F226L/R342V/R346I, M182G/T201R/V203A/L268I/R346I, M182G/T201R/F226L/K234H/R342V/R346I, M182G/T201R/F226L/E235T/R346I, M182G/T201R/F226L/L268V/R346I, M182G/T201R/R342V, M182G/V203A/F226L, M182G/F226L/K234H/R346I, M182G/F226L/K234R/L268I/R342V/R346I, M182G/F226L/K234R/R346I, M182G/F226L/E235T, M182G/F226L/E235T/L268V/R346I, M182G/F226L/E235T/R342L, M182G/F226L/E235T/R346I, M182G/F226L/L268I/R342V/R346I, M182G/F226L/R342V, M182G/F226L/R346I, T201R/V203A/F226L/K234H/R342V/R346I, T201R/V203A/F226L/R346I, T201R/V203A/L268I/R346I, T201R/V203A/L268V/R342V, T201R/F226L/K234H/R346I, T201R/F226L/K234R/R342L/R346I, T201R/F226L/E235T/R342L, T201R/F226L/L268I/R346I, V203A/F226L, V203A/F226L/K234R/E235T, V203A/F226L/E235T/L268V/R346I, V203A/F226L/E235T/R346I, V203A/F226L/R346I, L207E, L207E/R233S/D237R/L344M/V387I, L207E/V387L, F226L, F226L/K234R/R342V, F226L/E235T/L268I, F226L/E235T/L268V/R346I, F226L/E235T/R346I, F226L/L268I/R342V, F226L/L268I/R346I, F226L/L268V/R346I, F226L/R342V/R346I, F226L/R346I, and K259R/M276L/V387L.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3302 and one or more residue differences or residue difference sets as compared to SEQ ID NO: 3302, selected from: 75/207/373/378, 104/200/207/237/344/373/387, 104/207/344/387, 182/201/203/226/234/235/346, 182/201/203/226/234/342/346, 182/201/203/226/235, 182/201/203/226/235/346, 182/201/203/226/342/346, 182/201/203/268/346, 182/201/226/234/342/346, 182/201/226/235/346, 182/201/226/268/346, 182/203/226, 182/226/234/268/342/346, 182/226/234/346, 182/226/235, 182/226/235/268/346, 182/226/235/342, 182/226/235/346, 182/226/268/342/346, 182/226/342, 182/226/346, 201/203/226/234, 201/203/226/346, 201/203/268/342, 201/203/268/346, 201/226/234/342/346, 201/226/268/346, 201/226/346, 203/226, 203/226/234/235, 203/226/234/235/346, 203/226/235/268/346, 203/226/235/346, 203/226/346, 207, 207/233/237/344/387, 207/387, 226, 226/234/235/346, 226/235/268, 226/235/268/346, 226/235/342, 226/235/346, 226/268/342, 226/268/346, 226/342, 226/342/346, 226/346, and 259/276/387. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3302 and one or more residue differences or residue difference sets as compared to SEQ ID NO: 3302, selected from 75V/207E/373A/378V, 104L/200A/207E/237R/344M/373A/387L, 104L/207E/344T/387L, 182G/201R/203A/226L/234H/235T/346I, 182G/201R/203A/226L/234R/235T/346I, 182G/201R/203A/226L/234R/342V/346I, 182G/201R/203A/226L/235T, 182G/201R/203A/226L/235T/346I, 182G/201R/203A/226L/342V/346I, 182G/201R/203A/268I/346I, 182G/201R/226L/234H/342V/346I, 182G/201R/226L/235T/346I, 182G/201R/226L/268V/346I, 182G/203A/226L, 182G/226L/234H/346I, 182G/226L/234R/268I/342V/346I, 182G/226L/234R/346I, 182G/226L/235T, 182G/226L/235T/268V/346I, 182G/226L/235T/342L, 182G/226L/235T/346I, 182G/226L/268I/342V/346I, 182G/226L/342V, 182G/226L/346I, 201R/203A/226L/234H, 201R/203A/226L/346I, 201R/203A/268I/346I, 201R/203A/268V/342V, 201R/226L/234R/342L/346I, 201R/226L/268I/346I, 201R/226L/346I, 203A/226L, 203A/226L/234H/235T/346I, 203A/226L/234R/235T, 203A/226L/235T/268V/346I, 203A/226L/235T/346I, 203A/226L/346I, 207E, 207E/233S/237R/344M/387I, 207E/387L, 226L, 226L/234R/235T/346I, 226L/235T/268I, 226L/235T/268V/346I, 226L/235T/342V, 226L/235T/346I, 226L/268I/342V, 226L/268I/346I, 226L/268V/346I, 226L/342V, 226L/342V/346I, 226L/346I, and 259R/276L/387L. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3302 and one or more residue differences or residue difference sets as compared to SEQ ID NO: 3302, selected from: A75V/L207E/G373A/I378V, V104L/R200A/L207E/D237R/L344M/G373A/V387L, V104L/L207E/L344T/V387L, M182G/T201R/V203A/F226L/K234H/E235T/R346I, M182G/T201R/V203A/F226L/K234R/E235T/R346I, M182G/T201R/V203A/F226L/K234R/R342V/R346I, M182G/T201R/V203A/F226L/E235T, M182G/T201R/V203A/F226L/E235T/R346I, M182G/T201R/V203A/F226L/R342V/R346I, M182G/T201R/V203A/L268I/R346I, M182G/T201R/F226L/K234H/R342V/R346I, M182G/T201R/F226L/E235T/R346I, M182G/T201R/F226L/L268V/R346I, M182G/V203A/F226L, M182G/F226L/K234H/R346I, M182G/F226L/K234R/L268I/R342V/R346I, M182G/F226L/K234R/R346I, M182G/F226L/E235T, M182G/F226L/E235T/L268V/R346I, M182G/F226L/E235T/R342L, M182G/F226L/E235T/R346I, M182G/F226L/L268I/R342V/R346I, M182G/F226L/R342V, M182G/F226L/R346I, T201R/V203A/F226L/K234H, T201R/V203A/F226L/R346I, T201R/V203A/L268I/R346I, T201R/V203A/L268V/R342V, T201R/F226L/K234R/R342L/R346I, T201R/F226L/L268I/R346I, T201R/F226L/R346I, V203A/F226L, V203A/F226L/K234H/E235T/R346I, V203A/F226L/K234R/E235T, V203A/F226L/E235T/L268V/R346I, V203A/F226L/E235T/R346I, V203A/F226L/R346I, L207E, L207E/R233S/D237R/L344M/V387I, L207E/V387L, F226L, F226L/K234R/E235T/R346I, F226L/E235T/L268I, F226L/E235T/L268V/R346I, F226L/E235T/R342V, F226L/E235T/R346I, F226L/L268I/R342V, F226L/L268I/R346I, F226L/L268V/R346I, F226L/R342V, F226L/R342V/R346I, F226L/R346I, and K259R/M276L/V387L.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3302 and one or more residue differences or residue difference sets as compared to SEQ ID NO: 3302, selected from: 75/233/344, 75/233/366, 104/200/207/237/344/373/387, 104/207/344/387, 106/182/203/226/235/342/346, 182/201/203/226/234/235/346, 182/201/203/226/234/342/346, 182/201/203/226/235, 182/201/203/226/235/346, 182/201/203/226/342/346, 182/201/203/268/346, 182/201/226/234/342/346, 182/201/226/235/346, 182/201/226/268/346, 182/201/342, 182/203/226, 182/226/234/268/342/346, 182/226/234/346, 182/226/235, 182/226/235/268/346, 182/226/235/342, 182/226/235/346, 182/226/268/342/346, 182/226/342, 182/226/346, 182/342/346, 201/203/226/268/342, 201/203/226/346, 201/203/268/342, 201/203/268/346, 201/226/234/342/346, 201/226/235/342, 201/226/268/346, 201/226/346, 201/235/268/342/346, 203/226, 203/226/234/235, 203/226/234/235/346, 203/226/235/268/346, 203/226/235/346, 203/226/342/346, 203/226/346, 207, 207/233/237/344/387, 207/387, 226, 226/234/235/346, 226/234/342, 226/235/268, 226/235/268/346, 226/235/342, 226/235/346, 226/268/342, 226/268/346, 226/342, 226/342/346, 226/346, and 259/276/387. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3302 and one or more residue differences or residue difference sets as compared to SEQ ID NO: 3302, selected from 75V/233S/344T, 75V/233S/366E, 104L/200A/207E/237R/344M/373A/387L, 104L/207E/344T/387L, 106D/182G/203A/226L/235T/342L/346I, 182G/201R/203A/226L/234H/235T/346I, 182G/201R/203A/226L/234R/235T/346I, 182G/201R/203A/226L/234R/342V/346I, 182G/201R/203A/226L/235T, 182G/201R/203A/226L/235T/346I, 182G/201R/203A/226L/342V/346I, 182G/201R/203A/268I/346I, 182G/201R/226L/234H/342V/346I, 182G/201R/226L/235T/346I, 182G/201R/226L/268V/346I, 182G/201R/342V, 182G/203A/226L, 182G/226L/234H/346I, 182G/226L/234R/268I/342V/346I, 182G/226L/234R/346I, 182G/226L/235T, 182G/226L/235T/268V/346I, 182G/226L/235T/342L, 182G/226L/235T/346I, 182G/226L/268I/342V/346I, 182G/226L/342V, 182G/226L/346I, 182G/342L/346I, 201R/203A/226L/268I/342V, 201R/203A/226L/346I, 201R/203A/268I/346I, 201R/203A/268V/342V, 201R/226L/234R/342L/346I, 201R/226L/235T/342L, 201R/226L/268I/346I, 201R/226L/346I, 201R/235T/268V/342V/346I, 203A/226L, 203A/226L/234H/235T/346I, 203A/226L/234R/235T, 203A/226L/235T/268V/346I, 203A/226L/235T/346I, 203A/226L/342V/346I, 203A/226L/346I, 207E, 207E/233S/237R/344M/387I, 207E/387L, 226L, 226L/234H/342L, 226L/234R/235T/346I, 226L/234R/342V, 226L/235T/268I, 226L/235T/268V/346I, 226L/235T/342V, 226L/235T/346I, 226L/268I/342V, 226L/268I/346I, 226L/268V/342L, 226L/268V/346I, 226L/342V, 226L/342V/346I, 226L/346I, and 259R/276L/387L. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3302 and one or more residue differences or residue difference sets as compared to SEQ ID NO: 3302, selected from: A75V/R233S/L344T, A75V/R233S/K366E, V104L/R200A/L207E/D237R/L344M/G373A/V387L, V104L/L207E/L344T/V387L, E106D/M182G/V203A/F226L/E235T/R342L/R346I, M182G/T201R/V203A/F226L/K234H/E235T/R346I, M182G/T201R/V203A/F226L/K234R/E235T/R346I, M182G/T201R/V203A/F226L/K234R/R342V/R346I, M182G/

T201R/V203A/F226L/E235T, M182G/T201R/V203A/F226L/E235T/R346I, M182G/T201R/V203A/F226L/R342V/R346I, M182G/T201R/V203A/L268I/R346I, M182G/T201R/F226L/K234H/R342V/R346I, M182G/T201R/F226L/E235T/R346I, M182G/T201R/F226L/L268V/R346I, M182G/T201R/R342V, M182G/V203A/F226L, M182G/F226L/K234H/R346I, M182G/F226L/K234R/L268I/R342V/R346I, M182G/F226L/K234R/R346I, M182G/F226L/E235T, M182G/F226L/E235T/L268V/R346I, M182G/F226L/E235T/R342L, M182G/F226L/E235T/R346I, M182G/F226L/L268I/R342V/R346I, M182G/F226L/R342V, M182G/F226L/R346I, M182G/R342L/R346I, T201R/V203A/F226L/L268I/R342V, T201R/V203A/F226L/R346I, T201R/V203A/L268I/R346I, T201R/V203A/L268V/R342V, T201R/F226L/K234R/R342L/R346I, T201R/F226L/E235T/R342L, T201R/F226L/L268I/R346I, T201R/F226L/R346I, T201R/E235T/L268V/R342V/R346I, V203A/F226L, V203A/F226L/K234H/E235T/R346I, V203A/F226L/K234R/E235T, V203A/F226L/E235T/L268V/R346I, V203A/F226L/E235T/R346I, V203A/F226L/R342V/R346I, V203A/F226L/R346I, L207E, L207E/R233S/D237R/L344M/V387I, L207E/V387L, F226L, F226L/K234H/R342L, F226L/K234R/E235T/R346I, F226L/K234R/R342V, F226L/E235T/L268I, F226L/E235T/L268V/R346I, F226L/E235T/R342V, F226L/E235T/R346I, F226L/L268I/R342V, F226L/L268I/R346I, F226L/L268V/R342L, F226L/L268V/R346I, F226L/R342V, F226L/R342V/R346I, F226L/R346I, and K259R/M276L/V387L.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3398 and one or more residue differences or residue difference sets as compared to SEQ ID NO: 3398, selected from: 29/77/104/234/271, 29/77/104/234/271/279/380, 29/77/182/207/271, 29/77/207/234/279/380, 29/77/234/271/279/368, 29/77/271, 29/104/234/271/279/380, 29/182/207/380, 29/182/234/271/380, 29/182/271/279/380, 29/234/279/380, 29/271/279, 29/271/279/368/380, 32/78/106/200/226/272/373, 32/78/106/200/226/373, 32/78/106/226, 32/78/200/226, 32/78/200/226/235/272, 32/78/200/226/235/321/373, 32/78/226, 32/78/226/321, 32/78/226/373, 32/106/200/226, 32/106/200/226/235/373, 32/200/226, 32/200/226/321/373, 32/226, 77/182/279/380, 77/182/368, 77/234/271/279/380, 78/106, 78/106/226/321/373, 78/106/235/321/373, 78/200/226/321/373, 78/226/321, 104/182, 106/200/226/373, 106/226/235/373, 182/207/279/368, 182/234/380, 182/279/368/380, 200/226, 200/226/321/373, 200/226/373, 207/271/368/380, 207/380, 226, 226/235/272/373, 226/272/373, and 271/380. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3398 and one or more residue differences or residue difference sets as compared to SEQ ID NO: 3398, selected from: 29H/77V/104L/234P/271P, 29H/77V/104L/234R/271P/279H/380G, 29H/77V/182G/207E/271Q, 29H/77V/207E/234H/279H/380G, 29H/77V/234H/271P/279H/368Q, 29H/77V/271P, 29H/104L/234R/271Q/279H/380G, 29H/182G/207E/380G, 29H/182G/234P/271P/380G, 29H/182G/271Q/279H/380G, 29H/234H/279H/380G, 29H/271Q/279H, 29H/271Q/279H/368Q/380G, 32C/78L/106R/200A/226L/373N, 32C/78L/200A/226L, 32C/78L/200A/226L/235T/272D, 32C/78L/226L/321M, 32C/78L/226L/373N, 32C/106Q/200A/226L/235T/373N, 32C/106R/200A/226L, 32P/78L/106Q/226L, 32P/78L/106R/200A/226L/272D/373N, 32P/78L/106R/200A/226L/373A, 32P/78L/200A/226L/235T/321M/373N, 32P/78L/226L, 32P/78L/226L/373N, 32P/200A/226L, 32P/200A/226L/321M/373N, 32P/226L, 77V/182G/279H/380G, 77V/182G/368Q, 77V/234H/271Q/279H/380G, 78L/106Q, 78L/106R/226L/321M/373A, 78L/106R/226L/321M/373N, 78L/106R/235T/321M/373N, 78L/200A/226L/321M/373N, 78L/226L/321M, 104L/182G, 106R/200A/226L/373A, 106R/226L/235T/373A, 182G/207E/279H/368Q, 182G/234R/380G, 182G/279H/368Q/380G, 200A/226L, 200A/226L/321M/373N, 200A/226L/373A, 207E/271Q/368Q/380G, 207E/380G, 226L, 226L/235T/272D/373A, 226L/272D/373N, and 271P/380G. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3398 and one or more residue differences or residue difference sets as compared to SEQ ID NO: 3398, selected from: P29H/I77V/V104L/K234P/H271P, P29H/I77V/V104L/K234R/H271P/F279H/A380G, P29H/I77V/M182G/L207E/H271Q, P29H/I77V/L207E/K234H/F279H/A380G, P29H/I77V/K234H/H271P/F279H/I368Q, P29H/I77V/H271P, P29H/V104L/K234R/H271Q/F279H/A380G, P29H/M182G/L207E/A380G, P29H/M182G/K234P/H271P/A380G, P29H/M182G/H271Q/F279H/A380G, P29H/K234H/F279H/A380G, P29H/H271Q/F279H, P29H/H271Q/F279H/I368Q/A380G, Q32C/F78L/E106R/R200A/F226L/G373N, Q32C/F78L/R200A/F226L, Q32C/F78L/R200A/F226L/E235T/K272D, Q32C/F78L/F226L/I321M, Q32C/F78L/F226L/G373N, Q32C/E106Q/R200A/F226L/E235T/G373N, Q32C/E106R/R200A/F226L, Q32P/F78L/E106Q/F226L, Q32P/F78L/E106R/R200A/F226L/K272D/G373N, Q32P/F78L/E106R/R200A/F226L/G373A, Q32P/F78L/R200A/F226L/E235T/I321M/G373N, Q32P/F78L/F226L, Q32P/F78L/F226L/G373N, Q32P/R200A/F226L, Q32P/R200A/F226L/I321M/G373N, Q32P/F226L, I77V/M182G/F279H/A380G, I77V/M182G/I368Q, I77V/K234H/H271Q/F279H/A380G, F78L/E106Q, F78L/E106R/F226L/I321M/G373A, F78L/E106R/F226L/I321M/G373N, F78L/E106R/E235T/I321M/G373N, F78L/R200A/F226L/I321M/G373N, F78L/F226L/I321M, V104L/M182G, E106R/R200A/F226L/G373A, E106R/F226L/E235T/G373A, M182G/L207E/F279H/I368Q, M182G/K234R/A380G, M182G/F279H/I368Q/A380G, R200A/F226L, R200A/F226L/I321M/G373N, R200A/F226L/G373A, L207E/H271Q/I368Q/A380G, L207E/A380G, F226L, F226L/E235T/K272D/G373A, F226L/K272D/G373N, and H271P/A380G.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3074 and one or more residue differences or residue difference sets as compared to SEQ ID NO: 3074, selected from: 16, 201, 203, 230, 231, 234, 235, 238, 271, 273, 275, 279, 321, 344, 349, 368, 373, and 380. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3074 and one or more residue differences or residue difference sets as compared to SEQ ID NO: 3074, selected from: 16M, 201V, 203G, 203I, 230E, 231I, 234A, 234L, 234P, 234Q, 235C, 235V, 238V, 271P, 271Q, 273D, 275E, 279H, 321M, 344C, 349C, 368Q, 373N, 380G, and 380S. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3074 and one or more residue differences or residue difference sets as compared to SEQ ID NO: 3074, selected from: N16M, T201V, V203G, V203I, N230E, P231I, K234A, K234L, K234P, K234Q, M235C, M235V, E238V, H271P, H271Q, I273D, A275E, F279H, I321M, L344C, E349C, I368Q, G373N, A380G, and A380S.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3488 and one or more residue differences or residue difference sets as compared to SEQ ID NO: 3488, selected from: 14/15/77/78, 14/15/77/78/200/201/226/230/290, 14/15/77/78/200/203/230/290, 14/15/77/78/203/226/230/290, 14/15/77/200/226/230, 14/15/78, 14/15/78/226/230, 14/15/200/230, 14/77/78/200/226/230/257, 14/77/78/226/230/257, 14/77/201/230, 14/78/200/201/226/290, 14/78/200/201/339, 14/78/200/226/230/339, 14/78/200/226/290/339, 14/78/200/230/339, 14/200/203/226/230, 14/200/203/226/230/257/339, 14/200/203/230/339, 14/201/203/226, 15/77, 15/77/78, 15/77/78/200/201/203/226/230, 15/77/200/201/203/226/230/290/339, 15/77/200/230, 15/77/200/230/290/339, 15/77/201/226/230/339, 15/77/226/230/290/339, 15/78/201, 15/78/201/203/230, 15/78/201/230/290, 15/78/203/226/230, 15/200, 15/201/203/226/230/257/339, 15/226/230/339, 15/230, 32, 32/103, 32/103/106/207/210/235/321/368, 32/103/207/228/232/373, 32/103/210/273/321/373, 32/103/273, 32/106, 32/106/207/210/232, 32/106/210, 32/106/210/373, 32/106/235/321, 32/106/235/368, 32/106/273/321/373, 32/207/210/273, 32/207/210/368/373, 32/207/235, 32/210/232/235/368, 32/210/273, 32/235/273, 77/78/200/226/339, 77/78/201/226/257/339, 77/78/203, 77/78/203/230/339, 77/200/201, 77/200/201/226/230/339, 77/200/203/230/257/339, 77/200/230, 78, 78/200/230, 78/203/230/290, 78/226/230, 78/226/290, 103/106/207/321, 103/106/210, 103/207/210/235/321, 103/210/232/235, 103/232/273, 106, 106/207/210/232/235/321/368/373, 106/207/235/321/368, 106/235/273/373, 106/273, 200, 200/203/226/230/339, 200/230/257, 201, 201/203, 201/230/257, 201/230/290, 203, 203/226/230, 203/226/230/257, 207/235, 207/235/368, 207/368/373, 207/373, 232/235, 232/235/273/368, 232/235/321, 235, 235/273, and 273. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3488 and one or more residue differences or residue difference sets as compared to SEQ ID NO: 3488, selected from: 14E/15G/77V/78L, 14E/15G/77V/78L/200A/201L/226L/230P/290R, 14E/15G/77V/78L/200A/203S/230I/290H, 14E/15G/77V/78L/203S/226L/230I/290R, 14E/15G/77V/200A/226L/230P, 14E/15G/78L, 14E/15G/78L/226L/230P, 14E/15G/200A/230I, 14E/77V/78L/200A/226L/230P/257T, 14E/77V/78L/226L/230P/257T, 14E/77V/201L/230I, 14E/78L/200A/201L/226L/290R, 14E/78L/200A/201L/339I, 14E/78L/200A/226L/230P/339I, 14E/78L/200A/226L/290R/339I, 14E/78L/200A/230I/339I, 14E/200A/203S/226L/230I, 14E/200A/203S/226L/230P/257T/339I, 14E/200A/203S/230P/339I, 14E/201L/203S/226L, 15G/77V, 15G/77V/78L, 15G/77V/78L/200A/201L/203S/226L/230P, 15G/77V/200A/201L/203S/226L/230P/290R/339I, 15G/77V/200A/230P, 15G/77V/200A/230P/290R/339I, 15G/77V/201L/226L/230I/339I, 15G/77V/226L/230P/290R/339I, 15G/78L/201L, 15G/78L/201L/203S/230P, 15G/78L/201L/230P/290R, 15G/78L/203S/226L/230I, 15G/200A, 15G/201L/203S/226L/230P/257T/339I, 15G/226L/230I/339I, 15G/230I, 15G/230P, 32P, 32P/103P, 32P/103P/106R/207E/210L/235T/321M/368Q, 32P/103P/207E/228V/232I/373D, 32P/103P/210L/273P/321M/373D, 32P/103P/273P, 32P/106R, 32P/106R/207E/210L/232I, 32P/106R/210L, 32P/106R/210L/373D, 32P/106R/235T/321M, 32P/106R/235T/368Q, 32P/106R/273Q/321M/373D, 32P/207E/210L/273Q, 32P/207E/210L/368Q/373D, 32P/207E/235T, 32P/210L/232I/235T/368Q, 32P/210L/273P, 32P/235T/273Q, 77V/78L/200A/226L/339I, 77V/78L/201L/226L/257T/339I, 77V/78L/2035, 77V/78L/203S/230P/339I, 77V/200A/201L, 77V/200A/201L/226L/230P/339I, 77V/200A/203S/230P/257T/339I, 77V/200A/230P, 78L, 78L/200A/230P, 78L/203S/230P/290R, 78L/226L/230I, 78L/226L/230P, 78L/226L/290R, 103P/106R/207E/321M, 103P/106R/210L, 103P/207E/210L/235T/321M, 103P/210L/232N/235T, 103P/232I/273Q, 106R, 106R/207E/210L/232I/235T/321M/368Q/373D, 106R/207E/235T/321M/368Q, 106R/235T/273P/373D, 106R/273Q, 200A, 200A/203S/226L/230P/339I, 200A/230I/257T, 201L, 201L/2035, 201L/230P/257T, 201L/230P/290R, 203S, 203S/226L/230I/257T, 203S/226L/230P, 207E/235T, 207E/235T/368Q, 207E/368Q/373D, 207E/373D, 232I/235T/321M, 232N/235T, 232N/235T/273Q/368Q, 232N/235T/321M, 235T, 235T/273P, and 273P. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3488 and one or more residue differences or residue difference sets as compared to SEQ ID NO: 3488, selected from: P14E/S15G/I77V/F78L, P14E/S15G/I77V/F78L/R200A/T201L/F226L/N230P/Q290R, P14E/S15G/I77V/F78L/R200A/V203S/N230I/Q290H, P14E/S15G/I77V/F78L/V203S/F226L/N230I/Q290R, P14E/S15G/I77V/R200A/F226L/N230P, P14E/S15G/F78L, P14E/S15G/F78L/F226L/N230P, P14E/S15G/R200A/N230I, P14E/I77V/F78L/R200A/F226L/N230P/D257T, P14E/I77V/F78L/F226L/N230P/D257T, P14E/I77V/T201L/N230I, P14E/F78L/R200A/T201L/F226L/Q290R, P14E/F78L/R200A/T201L/Q339I, P14E/F78L/R200A/F226L/N230P/Q339I, P14E/F78L/R200A/F226L/Q290R/Q339I, P14E/F78L/R200A/N230I/Q339I, P14E/R200A/V203S/F226L/N230I, P14E/R200A/V203S/F226L/N230P/D257T/Q339I, P14E/R200A/V203S/N230P/Q339I, P14E/T201L/V203S/F226L, S15G/I77V, S15G/I77V/F78L, S15G/I77V/F78L/R200A/T201L/V203S/F226L/N230P, S15G/I77V/R200A/T201L/V203S/F226L/N230P/Q290R/Q339I, S15G/I77V/R200A/N230P, S15G/I77V/R200A/N230P/Q290R/Q339I, S15G/I77V/T201L/F226L/N230I/Q339I, S15G/I77V/F226L/N230P/Q290R/Q339I, S15G/F78L/T201L, S15G/F78L/T201L/V203S/N230P, S15G/F78L/T201L/N230P/Q290R, S15G/F78L/V203S/F226L/N230I, S15G/R200A, S15G/T201L/V203S/F226L/N230P/D257T/Q339I, S15G/F226L/N230I/Q339I, S15G/N230I, S15G/N230P, Q32P, Q32P/D103P, Q32P/D103P/E106R/L207E/I210L/E235T/I321M/I368Q, Q32P/D103P/L207E/I228V/G232I/G373D, Q32P/D103P/I210L/I273P/I321M/G373D, Q32P/D103P/I273P, Q32P/E106R, Q32P/E106R/L207E/I210L/G232I, Q32P/E106R/I210L, Q32P/E106R/I210L/G373D, Q32P/E106R/E235T/I321M, Q32P/E106R/E235T/I368Q, Q32P/E106R/I273Q/I321M/G373D, Q32P/L207E/I210L/I273Q, Q32P/L207E/I210L/I368Q/G373D, Q32P/L207E/E235T, Q32P/I210L/G232I/

E235T/I368Q, Q32P/I210L/I273P, Q32P/E235T/I273Q, I77V/F78L/R200A/F226L/Q339I, I77V/F78L/T201L/F226L/D257T/Q339I, I77V/F78L/V203S, I77V/F78L/V203S/N230P/Q339I, I77V/R200A/T201L, I77V/R200A/T201L/F226L/N230P/Q339I, I77V/R200A/V203S/N230P/D257T/Q339I, I77V/R200A/N230P, F78L, F78L/R200A/N230P, F78L/V203S/N230P/Q290R, F78L/F226L/N230I, F78L/F226L/N230P, F78L/F226L/Q290R, D103P/E106R/L207E/I321M, D103P/E106R/I210L, D103P/L207E/I210L/E235T/I321M, D103P/I210L/G232N/E235T, D103P/G232I/I273Q, E106R, E106R/L207E/I210L/G232I/E235T/I321M/I368Q/G373D, E106R/L207E/E235T/I321M/I368Q, E106R/E235T/I273P/G373D, E106R/I273Q, R200A, R200A/V203S/F226L/N230P/Q339I, R200A/N230I/D257T, T201L, T201L/V203S, T201L/N230P/D257T, T201L/N230P/Q290R, V203S, V203S/F226L/N230I/D257T, V203S/F226L/N230P, L207E/E235T, L207E/E235T/I368Q, L207E/I368Q/G373D, L207E/G373D, G232I/E235T/I321M, G232N/E235T, G232N/E235T/I273Q/I368Q, G232N/E235T/I321M, E235T, E235T/I273P, and I273P.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3488 and one or more residue differences or residue difference sets as compared to SEQ ID NO: 3488, selected from: 14/15/77/78/200/201/226/230/290, 14/15/77/78/200/203/230/290, 14/15/77/78/203/226/230/290, 14/15/77/200/226/230, 14/15/78/226/230, 14/15/200/230, 14/77/78/200/226/230/257, 14/77/201/230, 14/78/200/226/230/339, 14/78/200/226/290/339, 14/200/203/226/230, 14/201/203/226, 15/77, 15/77/78/200/201/203/226/230, 15/77/200/230, 15/77/201/226/230/339, 15/78/201/203/230, 15/78/203/226/230, 15/230, 32, 32/103/106/207/210/235/321/368, 32/103/210/273/321/373, 32/103/273, 32/106/207/210/232, 32/106/210, 32/106/235/368, 32/207/210/368/373, 32/207/235, 32/210/232/273/321, 32/210/232/273/368/373, 32/210/273, 32/235/273, 77/78/200/226/339, 77/200/230, 78/203/230/290, 78/226/230, 78/226/290, 103/106/207/321, 103/106/210, 103/207/210/235/321, 103/210/232/235, 103/232/273, 106/207/235/321/368, 106/235/273/373, 201/203, 203/226/230, 207/235/368, 232/235, 232/235/321, 235, and 235/273. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3488 and one or more residue differences or residue difference sets as compared to SEQ ID NO: 3488, selected from: 14E/15G/77V/78L/200A/201L/226L/230P/290R, 14E/15G/77V/78L/200A/203S/230I/290H, 14E/15G/77V/78L/203S/226L/230I/290R, 14E/15G/77V/200A/226L/230P, 14E/15G/78L/226L/230P, 14E/15G/200A/230I, 14E/77V/78L/200A/226L/230P/257T, 14E/77V/201L/230I, 14E/78L/200A/226L/230P/339I, 14E/78L/200A/226L/290R/339I, 14E/200A/203S/226L/230I, 14E/201L/203S/226L, 15G/77V, 15G/77V/78L/200A/201L/203S/226L/230P, 15G/77V/200A/230P, 15G/77V/201L/226L/230I/339I, 15G/78L/201L/203S/230P, 15G/78L/203S/226L/230I, 15G/230I, 32P, 32P/103P/106R/207E/210L/235T/321M/368Q, 32P/103P/210L/273P/321M/373D, 32P/103P/273P, 32P/106R/207E/210L/232I, 32P/106R/210L, 32P/106R/235T/368Q, 32P/207E/210L/368Q/373D, 32P/207E/235T, 32P/210L/232I/273P/321M, 32P/210L/232N/273Q/368Q/373D, 32P/210L/273P, 32P/235T/273Q, 77V/78L/200A/226L/339I, 77V/200A/230P, 78L/203S/230P/290R, 78L/226L/230I, 78L/226L/230P, 78L/226L/290R, 103P/106R/207E/321M, 103P/106R/210L, 103P/207E/210L/235T/321M, 103P/210L/232N/235T, 103P/232I/273Q, 106R/207E/235T/321M/368Q, 106R/235T/273P/373D, 201L/203S, 203S/226L/230P, 207E/235T/368Q, 232N/235T, 232N/235T/321M, 235T, and 235T/273P. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3488 and one or more residue differences or residue difference sets as compared to SEQ ID NO: 3488, selected from: P14E/S15G/I77V/F78L/R200A/T201L/F226L/N230P/Q290R, P14E/S15G/I77V/F78L/R200A/V203S/N230I/Q290H, P14E/S15G/I77V/F78L/V203S/F226L/N230I/Q290R, P14E/S15G/I77V/R200A/F226L/N230P, P14E/S15G/F78L/F226L/N230P, P14E/S15G/R200A/N230I, P14E/I77V/F78L/R200A/F226L/N230P/D257T, P14E/I77V/T201L/N230I, P14E/F78L/R200A/F226L/N230P/Q339I, P14E/F78L/R200A/F226L/Q290R/Q339I, P14E/R200A/V203S/F226L/N230I, P14E/T201L/V203S/F226L, S15G/I77V, S15G/I77V/F78L/R200A/T201L/V203S/F226L/N230P, S15G/I77V/R200A/N230P, S15G/I77V/T201L/F226L/N230I/Q339I, S15G/F78L/T201L/V203S/N230P, S15G/F78L/V203S/F226L/N230I, S15G/N230I, Q32P, Q32P/D103P/E106R/L207E/I210L/E235T/I321M/I368Q, Q32P/D103P/I210L/I273P/I321M/G373D, Q32P/D103P/I273P, Q32P/E106R/L207E/I210L/G232I, Q32P/E106R/I210L, Q32P/E106R/E235T/I368Q, Q32P/L207E/I210L/I368Q/G373D, Q32P/L207E/E235T, Q32P/I210L/G232I/I273P/I321M, Q32P/I210L/G232N/I273Q/I368Q/G373D, Q32P/I210L/I273P, Q32P/E235T/I273Q, I77V/F78L/R200A/F226L/Q339I, I77V/R200A/N230P, F78L/V203S/N230P/Q290R, F78L/F226L/N230I, F78L/F226L/N230P, F78L/F226L/Q290R, D103P/E106R/L207E/I321M, D103P/E106R/I210L, D103P/L207E/I210L/E235T/I321M, D103P/I210L/G232N/E235T, D103P/G232I/I273Q, E106R/L207E/E235T/I321M/I368Q, E106R/E235T/I273P/G373D, T201L/V203S, V203S/F226L/N230P, L207E/E235T/I368Q, G232N/E235T, G232N/E235T/I321M, E235T, and E235T/I273P.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3958 and one or more residue differences or residue difference sets as compared to SEQ ID NO: 3958, selected from: 53, 262, 264, 265, 266, 267, 270, 271, 272, 273, 275, 277, 321, 322, 324, 325, 339, 346, 347, 350, 355, 360, 370, 371, 376, 380, 383, 386, and 388. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3958 and one or more residue differences or residue difference sets as compared to SEQ ID NO: 3958, selected from: 53T, 262R, 264E, 264S, 265P, 266D, 266T, 267G, 267S, 270N, 271G, 272R, 273P, 273V, 275G, 275K, 275Q, 275R, 277S, 321C, 321S, 321V, 322A, 324A, 324E, 324L, 324P, 324R, 325A, 325H, 325K, 325T, 325V, 339M, 346L, 347F, 347W, 350W, 355P, 360N, 360S, 370Y, 371E, 371G, 376A, 380S, 380T, 383D, 383E, 383V, 386W, and 388H. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3958 and one or more residue differences or residue difference sets as compared to SEQ ID NO: 3958, selected from: E53T, T262R, V264E, V264S, E265P, G266D, G266T, Q267G, Q267S, S270N, P271G, K272R, I273P, I273V, A275G, A275K, A275Q, A275R, D277S, I321C, I321S, I321V, T322A, F324A, F324E, F324L, F324P, F324R, E325A, E325H, E325K, E325T, E325V, Q339M, R346L, Y347F, Y347W, E350W, L355P, R360N, R360S, L370Y, S371E, S371G, E376A, G380S, G380T, G383D, G383E, G383V, Y386W, and E388H.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3958 and one or more residue differences or residue difference sets as compared to SEQ ID NO: 3958, selected from: 53, 219, 229, 262, 264, 265, 266, 267, 270, 271, 272, 273, 275, 277, 278, 280, 321, 322, 324, 325, 339, 346, 347, 350, 355, 360, 370, 371, 376, 380, 383, 386, 387, 388, and 390. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3958 and one or more residue differences or residue difference sets as compared to SEQ ID NO: 3958, selected from: 53T, 219T, 229V, 262R, 264E, 265P, 266D, 266T, 267E, 267G, 267S, 270N, 271G, 271T, 272R, 273P, 273V, 275G, 275K, 275Q, 275R, 275S, 277S, 278G, 278P, 280S, 321C, 321S, 321V, 322A, 324A, 324D, 324E, 324L, 324P, 324R, 324V, 325A, 325G, 325H, 325K, 325P, 325R, 325V, 339M, 346L, 346Q, 347F, 347W, 350W, 355P, 360N, 360S, 370Y, 371E, 371G, 376A, 376R, 376T, 380S, 380T, 383D, 383E, 383T, 383V, 386W, 387I, 388H, and 390A. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3958 and one or more residue differences or residue difference sets as compared to SEQ ID NO: 3958, selected from: E53T, P219T, T229V, T262R, V264E, E265P, G266D, G266T, Q267E, Q267G, Q267S, S270N, P271G, P271T, K272R, I273P, I273V, A275G, A275K, A275Q, A275R, A275S, D277S, N278G, N278P, Q280S, I321C, I321S, I321V, T322A, F324A, F324D, F324E, F324L, F324P, F324R, F324V, E325A, E325G, E325H, E325K, E325P, E325R, E325V, Q339M, R346L, R346Q, Y347F, Y347W, E350W, L355P, R360N, R360S, L370Y, S371E, S371G, E376A, E376R, E376T, G380S, G380T, G383D, G383E, G383T, G383V, Y386W, L387I, E388H, and W390A.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3958 and one or more residue differences or residue difference sets as compared to SEQ ID NO: 3958, selected from: 72, 264, 267, 270, 271, 272, 273, 280, 321, 322, 324, 325, 339, 346, 347, 349, 355, 360, 371, and 383. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3958 and one or more residue differences or residue difference sets as compared to SEQ ID NO: 3958, selected from: 72R, 264E, 264Q, 264S, 267M, 270N, 271G, 272R, 273P, 273V, 280S, 321S, 321V, 322A, 324D, 324E, 324L, 324R, 324V, 325K, 325R, 339M, 346S, 347F, 349A, 349S, 349V, 355P, 360G, 360S, 360T, 371R, 383D, and 383E. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3958 and one or more residue differences or residue difference sets as compared to SEQ ID NO: 3958, selected from: K72R, V264E, V264Q, V264S, Q267M, S270N, P271G, K272R, I273P, I273V, Q280S, I321S, I321V, T322A, F324D, F324E, F324L, F324R, F324V, E325K, E325R, Q339M, R346S, Y347F, E349A, E349S, E349V, L355P, R360G, R360S, R360T, S371R, G383D, and G383E.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3788 and one or more residue differences or residue difference sets as compared to SEQ ID NO: 3788, selected from: 32/103/207/210/344/349, 32/103/207/321/344, 32/207/210/279, 32/273/344/373, 32/279, 32/279/321, 104/106, 104/106/111/200/201/235/268/368, 104/106/200/201/268, 106/111/200/235/368, 106/200/201, 106/200/201/209/368, 106/200/201/368, 106/201/235, 111, 200/235/368, 201/368, 207/210/273/279/344, 207/210/273/321/344/349, 207/273, 210, 210/273/279, 210/279, 273/279, and 273/279/373. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3788 and one or more residue differences or residue difference sets as compared to SEQ ID NO: 3788, selected from: 32P/103P/207E/210L/344T/349S, 32P/103P/207E/321M/344T, 32P/207E/210L/279H, 32P/273P/344T/373D, 32P/279H, 32P/279H/321M, 104L/106Q/111V/200A/201L/235T/268I/368Q, 104L/106R, 104L/106R/200A/201R/268I, 106Q/200A/201R/368Q, 106Q/201L/235T, 106R/111V/200A/235T/368Q, 106R/200A/201L, 106R/200A/201R/209A/368Q, 111V, 200A/235T/368Q, 201L/368Q, 207E/210L/273P/279H/344T, 207E/210L/273P/321M/344T/3495, 207E/273P, 210L, 210L/273P/279H, 210L/279H, 273P/279H, and 273P/279H/373D. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3788 and one or more residue differences or residue difference sets as compared to SEQ ID NO: 3788, selected from: Q32P/D103P/L207E/I210L/L344T/E349S, Q32P/D103P/L207E/I321M/L344T, Q32P/L207E/I210L/F279H, Q32P/I273P/L344T/G373D, Q32P/F279H, Q32P/F279H/I321M, V104L/E106Q/E111V/R200A/T201L/E235T/L268I/I368Q, V104L/E106R, V104L/E106R/R200A/T201R/L268I, E106Q/R200A/T201R/I368Q, E106Q/T201L/E235T, E106R/E111V/R200A/E235T/I368Q, E106R/R200A/T201L, E106R/R200A/T201R/T209A/I368Q, E111V, R200A/E235T/I368Q, T201L/I368Q, L207E/I210L/I273P/F279H/L344T, L207E/I210L/I273P/I321M/L344T/E349S, L207E/I273P, I210L, I210L/I273P/F279H, I210L/F279H, I273P/F279H, and I273P/F279H/G373D.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3788 and one or more residue differences or residue difference sets as compared to SEQ ID NO: 3788, selected from: 32/103/207/210/344/349, 32/103/207/321/344, 32/103/321/344, 32/207/210/279, 32/207/273/279/321, 32/207/279, 32/207/344, 32/273/279/344/349, 32/273/344/373, 32/279, 32/279/321, 104/106, 104/106/111/200/201/235/268/368, 104/106/111/200/201/268, 104/106/111/201/235/368, 106, 106/111/200/201, 106/111/200/201/268/368, 106/111/200/235/368, 106/111/201, 106/111/201/368, 106/200/201, 106/200/201/235, 106/201/235, 106/201/268, 111, 111/200/201/268, 111/200/368, 200/235/368, 200/368, 207/210/273/279/344, 207/210/273/279/344/349/373, 207/210/273/321/344/349, 207/273, 207/279/349, 210, 210/273/279, 210/273/279/349, 210/279, 273/279, and 273/279/373. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3788 and one or more residue differences or residue difference sets as compared to SEQ ID NO: 3788, selected from: 32P/103P/207E/210L/344T/349S, 32P/103P/207E/321M/344T, 32P/103P/321M/344T, 32P/207E/210L/279H, 32P/207E/273P/279H/321M, 32P/207E/279H, 32P/207E/344T, 32P/273P/279H/344T/349S, 32P/273P/344T/373D, 32P/279H, 32P/279H/321M, 104L/106Q/111V/200A/201L/235T/268I/368Q, 104L/106R, 104L/106R/111V/200A/201L/268I, 104L/106R/111V/201R/235T/368Q, 106Q/200A/201R/235T, 106Q/201L/235T, 106R, 106R/111V/200A/201L, 106R/111V/200A/201L/268I/368Q, 106R/111V/200A/201R/268I/368Q, 106R/111V/200A/235T/368Q, 106R/111V/201L, 106R/111V/201R/368Q, 106R/200A/201L, 106R/201R/268I, 111V, 111V/200A/201R/268I, 111V/200A/368Q, 200A/235T/368Q, 200A/368Q, 207E/210L/273P/279H/344T, 207E/210L/273P/279H/344T/349S/373D, 207E/210L/273P/321M/344T/349S, 207E/273P, 207E/279H/349S, 210L, 210L/273P/279H, 210L/273P/279H/349S, 210L/279H, 273P/279H, and 273P/279H/373D. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 3788 and one or more residue differences or residue difference sets as compared to SEQ ID NO: 3788, selected from: Q32P/D103P/L207E/I210L/L344T/E349S, Q32P/D103P/L207E/I321M/L344T, Q32P/D103P/I321M/L344T, Q32P/L207E/I210L/F279H, Q32P/L207E/I273P/F279H/I321M, Q32P/L207E/F279H, Q32P/L207E/L344T, Q32P/I273P/F279H/L344T/E349S, Q32P/I273P/L344T/G373D, Q32P/F279H, Q32P/F279H/I321M, V104L/E106Q/E111V/R200A/T201L/E235T/L286I/I368Q, V104L/E106R, V104L/E106R/E111V/R200A/T201L/L286I, V104L/E106R/E111V/T201R/E235T/I368Q, E106Q/R200A/T201R/E235T, E106Q/T201L/E235T, E106R, E106R/E111V/R200A/T201L, E106R/E111V/R200A/T201L/L286I/I368Q, E106R/E111V/R200A/T201R/L286I/I368Q, E106R/E111V/R200A/E235T/I368Q, E106R/E111V/T201L, E106R/E111V/T201R/I368Q, E106R/R200A/T201L, E106R/T201R/L268I, E111V, E111V/R200A/T201R/L268I, E111V/R200A/I368Q, R200A/E235T/I368Q, R200A/I368Q, L207E/I210L/I273P/F279H/L344T, L207E/I210L/I273P/F279H/L344T/E349S/G373D, L207E/I210L/I273P/I321M/L344T/E349S, L207E/I273P, L207E/F279H/E349S, I210L, I210L/I273P/F279H, I210L/I273P/F279H/E349S, I210L/F279H, I273P/F279H, and I273P/F279H/G373D.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4124 and one or more residue differences or residue difference sets as compared to SEQ ID NO: 4124, selected from: 32, 32/111/235, 32/111/235/271/272/339, 32/111/235/339, 32/111/235/386, 32/235, 32/235/271/339, 32/235/272, 32/235/272/339, 32/235/272/386, 32/235/339/386, 32/271/339, 32/272, 68/106/200, 68/344/383, 74/106/270/344, 103/324, 106/200/321/322/383, 106/270/344, 111/235, 111/235/271/339, 111/235/272/339/386, 111/235/339, 111/272/339/386, 200, 200/270, 200/270/322/383, 200/344, 235, 235/271/272/339/386, 235/271/339, 235/271/339/386, 235/272, 235/272/339, 235/272/386, 235/339, 235/339/386, 270/322/344/383, 324, 325, 344, 344/370, and 370. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4124 and one or more residue differences or residue difference sets as compared to SEQ ID NO: 4124, selected from: 32P, 32P/111V/235T, 32P/111V/235T/271G/272R/339T, 32P/111V/235T/339M, 32P/111V/235T/339N, 32P/111V/235T/386W, 32P/235T, 32P/235T/271G/339T, 32P/235T/272R, 32P/235T/272R/339M, 32P/235T/272R/386W, 32P/235T/339M/386W, 32P/235T/339N/386W, 32P/271G/339M, 32P/272R, 68G/106R/200A, 68G/344T/383D, 74V/106R/270N/344T, 103P/324E, 106R/200A/321V/322A/383D, 106R/270N/344T, 111V/235T, 111V/235T/271G/339N, 111V/235T/272R/339N/386W, 111V/235T/339T, 111V/272R/339N/386W, 200A, 200A/270N, 200A/270N/322A/383D, 200A/344T, 235T, 235T/271G/272R/339M/386W, 235T/271G/339M/386W, 235T/271G/339N, 235T/272R, 235T/272R/339M, 235T/272R/339T, 235T/272R/386W, 235T/339M, 235T/339M/386W, 235T/339N, 235T/339N/386W, 270N/322A/344T/383D, 324R, 325H, 344T, 344T/370Y, and 370Y. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4124 and one or more residue differences or residue difference sets as compared to SEQ ID NO: 4124, selected from: Q32P, Q32P/E111V/E235T, Q32P/E111V/E235T/P271G/K272R/Q339T, Q32P/E111V/E235T/Q339M, Q32P/E111V/E235T/Q339N, Q32P/E111V/E235T/Y386W, Q32P/E235T, Q32P/E235T/P271G/Q339T, Q32P/E235T/K272R, Q32P/E235T/K272R/Q339M, Q32P/E235T/K272R/Y386W, Q32P/E235T/Q339M/Y386W, Q32P/E235T/Q339N/Y386W, Q32P/P271G/Q339M, Q32P/K272R, C68G/E106R/R200A, C68G/L344T/G383D, A74V/E106R/S270N/L344T, D103P/F324E, E106R/R200A/I321V/T322A/G383D, E106R/S270N/L344T, E111V/E235T, E111V/E235T/P271G/Q339N, E111V/E235T/K272R/Q339N/Y386W, E111V/E235T/Q339T, E111V/K272R/Q339N/Y386W, R200A, R200A/S270N, R200A/S270N/T322A/G383D, R200A/L344T, E235T, E235T/P271G/K272R/Q339M/Y386W, E235T/P271G/Q339M/Y386W, E235T/P271G/Q339N, E235T/K272R, E235T/K272R/Q339M, E235T/K272R/Q339T, E235T/K272R/Y386W, E235T/Q339M, E235T/Q339M/Y386W, E235T/Q339N, E235T/Q339N/Y386W, S270N/T322A/L344T/G383D, F324R, E325H, L344T, L344T/L370Y, and L370Y.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4124 and one or more residue differences or residue difference sets as compared to SEQ ID NO: 4124, selected from: 32/111/235, 32/111/235/339, 32/111/235/339/386, 32/111/235/386, 32/235, 32/235/272/339, 32/235/272/386, 32/235/339/386, 32/339, 68/106/200, 68/106/321/322, 68/200, 68/200/270/321, 68/270/321/322, 68/344, 68/344/383, 74/106/270/344, 103/324, 106/200/321/322/383, 106/270/344, 111/235, 111/235/272/339/386, 111/235/339, 111/272/339/386, 200, 200/270, 200/270/322/383, 200/344, 229, 229/325, 235, 235/271/272/339, 235/272, 235/272/339, 235/272/386, 235/339, 235/339/386, 262, 262/325/349, 270/322/344/383, 278, 324, 325, 344, 344/370, 349, and 370. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4124 and one or more residue differences or residue difference sets as compared to SEQ ID NO: 4124, selected from: 32P/111V/235T, 32P/111V/235T/339M, 32P/111V/235T/339N, 32P/111V/235T/339T/386W, 32P/111V/235T/386W, 32P/235T, 32P/235T/272R/339M, 32P/235T/272R/386W, 32P/235T/339M/386W, 32P/235T/339N/386W, 32P/235T/339T/386W, 32P/339N, 68G/106R/200A, 68G/106R/321V/322A, 68G/200A, 68G/200A/270N/321V, 68G/270N/321V/322A, 68G/344T, 68G/344T/383D, 74V/106R/270N/344T, 103P/324E, 106R/200A/321V/322A/383D, 106R/270N/344T, 111V/235T, 111V/235T/272R/339N/386W, 111V/235T/339T, 111V/272R/339N/386W, 200A, 200A/270N, 200A/270N/322A/383D, 200A/344T, 229V, 229V/325H, 235T, 235T/271G/272R/339N, 235T/272R, 235T/272R/339M, 235T/272R/339T, 235T/272R/386W, 235T/339M, 235T/339M/386W, 235T/339N, 235T/339N/386W, 262R, 262R/325H/349N, 270N/322A/344T/383D, 278R, 324R, 325H, 344T, 344T/370Y, 349N, and 370Y. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4124 and one or more residue differences or residue difference sets as compared to SEQ ID NO: 4124, selected from: Q32P/E111V/E235T, Q32P/E111V/E235T/Q339M, Q32P/E111V/E235T/Q339N, Q32P/E111V/E235T/Q339T/Y386W, Q32P/E111V/E235T/Y386W, Q32P/E235T, Q32P/E235T/K272R/Q339M, Q32P/E235T/K272R/Y386W, Q32P/E235T/Q339M/Y386W, Q32P/E235T/Q339N/Y386W, Q32P/E235T/Q339T/Y386W, Q32P/Q339N, C68G/E106R/R200A, C68G/E106R/I321V/T322A, C68G/R200A, C68G/R200A/S270N/I321V, C68G/S270N/I321V/T322A, C68G/L344T, C68G/L344T/G383D, A74V/E106R/S270N/L344T, D103P/F324E, E106R/R200A/I321V/T322A/G383D, E106R/S270N/L344T, E111V/E235T, E111V/E235T/K272R/Q339N/Y386W, E111V/E235T/Q339T, E111V/K272R/Q339N/Y386W, R200A, R200A/S270N, R200A/S270N/T322A/G383D, R200A/L344T, T229V, T229V/E325H, E235T, E235T/P271G/K272R/Q339N, E235T/K272R, E235T/K272R/Q339M, E235T/K272R/Q339T, E235T/K272R/Y386W, E235T/Q339M, E235T/Q339M/Y386W, E235T/Q339N, E235T/Q339N/Y386W, T262R, T262R/E325H/E349N, S270N/T322A/L344T/G383D, N278R, F324R, E325H, L344T, L344T/L370Y, E349N, and L370Y.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4124 and one or more residue differences or residue difference sets as compared to SEQ ID NO: 4124, selected from: 9/302, 26, 44/193, 47, 54, 58, 62, 63, 64, 70, 89, 99, 110, 144, 153, 154, 155, 159, 161, 162, 163, 164, 170, 174, 181, 184, 189, 190, 192, 193, 194, 220, 237, 238, 241, 243, 244, 245, 246, 248, 249, 250, 252, 258, 260, 275/291, 284, 289, 291, 293, 294, 295, 296, 300, 301, 302, 303, 304, 305, 306, 307, 308, and 309. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4124 and one or more residue differences or residue difference sets as compared to SEQ ID NO: 4124, selected from: 9D/302S, 26A, 26F, 26Q, 26T, 44C/193D, 47L, 54R, 54V, 58D, 58S, 62A, 62G, 63S, 64Y, 70S, 89M, 89T, 99G, 99N, 99Q, 99V, 110M, 110N, 110S, 110V, 144I, 153C, 153M, 154L, 155Y, 159R, 159W, 161P, 162A, 162F, 162G, 162I, 162P, 163V, 164C, 164M, 170F, 174R, 181L, 184T, 189G, 189R, 190I, 192L, 193A, 193C, 193D, 193G, 193K, 193Y, 194L, 220S, 220Y, 237C, 237P, 237S, 237T, 237Y, 238S, 241P, 243A, 244C, 244I, 245G, 2461, 246M, 248R, 249N, 250R, 252S, 258C, 258V, 260N, 275S/291N, 284S, 289D, 291N, 291R, 293A, 293G, 293I, 293S, 293T, 294A, 294K, 294V, 295L, 295P, 295S, 296R, 300M, 300P, 300S, 300V, 301G, 301T, 302C, 302G, 302L, 303G, 303N, 303Q, 303Y, 304V, 304W, 305P, 305S, 305T, 305V, 306C, 306T, 307E, 307R, 307S, 308F, 308I, 308L, 308R, 308S, 309C, 309D, 309L, 309N, 309Q, 309R, 309T, and 309Y. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4124 and one or more residue differences or residue difference sets as compared to SEQ ID NO: 4124, selected from: G9D/K302S, I26A, I26F, I26Q, I26T, Y44C/L193D, K47L, I54R, I54V, N58D, N58S, K62A, K62G, E63S, N64Y, E70S, K89M, K89T, D99G, D99N, D99Q, D99V, E110M, E110N, E110S, E110V, E1441, T153C, T153M, V154L, E155Y, A159R, A159W, K161P, S162A, S162F, S162G, S1621, S162P, L163V, K164C, K164M, K170F, L174R, S181L, S184T, D189G, D189R, A190I, T192L, L193A, L193C, L193D, L193G, L193K, L193Y, I194L, M220S, M220Y, D237C, D237P, D237S, D237T, D237Y, E238S, H241P, V243A, V244C, V2441, D245G, L2461, L246M, K248R, K249N, Q250R, L252S, I258C, I258V, E260N, A275S/P291N, A284S, Y289D, P291N, P291R, V293A, V293G, V2931, V293S, V293T, D294A, D294K, D294V, N295L, N295P, N295S, S296R, T300M, T300P, T300S, T300V, S301G, S301T, K302C, K302G, K302L, K303G, K303N, K303Q, K303Y, S304V, S304W, D305P, D305S, D305T, D305V, M306C, M306T, A307E, A307R, A307S, E308F, E3081, E308L, E308R, E308S, V309C, V309D, V309L, V309N, V309Q, V309R, V309T, and V309Y.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4124 and one or more residue differences or residue difference sets as compared to SEQ ID NO: 4124, selected from: 9/302, 26, 55, 58, 62, 91, 110, 143, 148, 154, 162, 163, 173, 174, 184, 190, 192, 193, 194, 196, 205, 206, 220, 232, 237, 238, 245, 246, 248, 249, 253, 275/291, 284, 286, 287, 289, 291, 293, 295, 296, 300, 301, 302, 303, 304, 305, 306, 307, 308, and 309. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4124 and one or more residue differences or residue difference sets as compared to SEQ ID NO: 4124, selected from: 9D/302S, 26A, 26G, 26Q, 26T, 55V, 58D, 62R, 62W, 91L, 110L, 110M, 110N, 110T, 110V, 110Y, 143A, 148M, 154L, 162A, 162C, 162F, 162T, 162V, 1631, 173M, 174E, 184L, 184Q, 184T, 190C, 190G, 192D, 193A, 193C, 193D, 193G, 193V, 193Y, 194C, 194L, 196A, 205A, 205E, 206P, 220S, 232N, 237C, 237L, 237P, 237S, 237T, 237Y, 238S, 245C, 245S, 2461, 248R, 249G, 249L, 249S, 253M, 275S/291N, 284S, 286C, 287R, 289M, 289V, 291N, 291R, 291Y, 2931, 293S, 293T, 295L, 296C, 296R, 300F, 300M, 300P, 300V, 301A, 301G, 301T, 301V, 302A, 302C, 302L, 303A, 303G, 303M, 303N, 303P, 303R, 304G, 304L, 304V, 305G, 305S, 306A, 306G, 306L, 306P, 306T, 306W, 307S, 308L, 309A, 309D, 309F, 309L, 309N, and 309Y. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4124 and one or more residue differences or residue difference sets as compared to SEQ ID NO: 4124, selected from: G9D/K302S, 126A, 126G, 126Q, 126T, M55V, N58D, K62R, K62W, 191L, E110L, E110M, E110N, E110T, E110V, E110Y, S143A, R148M, V154L, S162A, S162C, S162F, S162T, S162V, L163I, F173M, L174E, S184L, S184Q, S184T, A190C, A190G, T192D, L193A, L193C, L193D, L193G, L193V, L193Y, I194C, I194L, K196A, D205A, D205E, A206P, M220S, G232N, D237C, D237L, D237P, D237S, D237T, D237Y, E238S, D245C, D245S, L2461, K248R, K249G, K249L, K249S, L253M, A275S/P291N, A284S, L286C, K287R, Y289M, Y289V, P291N, P291R, P291Y, V2931, V293S, V293T, N295L, S296C, S296R, T300F, T300M, T300P, T300V, S301A, S301G, S301T, S301V, K302A, K302C, K302L, K303A, K303G, K303M, K303N, K303P, K303R, S304G, S304L, S304V, D305G, D305S, M306A, M306G, M306L, M306P, M306T, M306W, A307S, E308L, V309A, V309D, V309F, V309L, V309N, and V309Y.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4226 and one or more residue differences or residue difference sets as compared to SEQ ID NO: 4226, selected from: 32/103/106/111/322/324, 32/106/280, 32/235, 32/235/386, 32/321/324/360, 32/324, 60/106/111/235/360, 60/280/360, 74/200/339, 103, 103/106/360, 103/111/235/280/360, 103/111/235/321/324, 106, 106/111, 106/111/322/383/386, 106/235, 106/235/383/386, 106/324, 111, 111/235/280, 111/322/360, 200/270/275/339, 235, 235/280, 235/280/321/322/324, 235/280/321/324/383/386, 267/270/275/339/347, 267/272/275, 280, 280/383, 321/324, and 360/383. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4226 and one or more residue differences or residue difference sets as compared to SEQ ID NO: 4226, selected from: 32P/103P/106R/111V/322T/324E, 32P/106R/280S, 32P/235T, 32P/235T/386W, 32P/321V/324D/360S, 32P/324D, 60R/106R/111V/235T/360S, 60R/280S/360S, 74V/200A/339M, 103P, 103P/106R/360S, 103P/111V/235T/280S/360S, 103P/111V/235T/321V/324D, 106R, 106R/111V, 106R/111V/322T/383E/386W, 106R/235T, 106R/235T/383E/386W, 106R/324D, 111V, 111V/235T/280S, 111V/322T/360S, 200A/270S/275K/339M, 235T, 235T/280S, 235T/280S/321V/322T/324D, 235T/280S/321V/324E/383E/386W, 267M/270S/275K/339M/347F, 267M/272R/275K, 280S, 280S/383E, 321V/324R, and 360S/383E. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4226 and one or more residue differences or residue difference sets as compared to SEQ ID NO: 4226, selected from: Q32P/D103P/E106R/E111V/A322T/F324E, Q32P/E106R/Q280S, Q32P/E235T, Q32P/E235T/Y386W, Q32P/I321V/F324D/R360S, Q32P/F324D, K60R/E106R/E111V/E235T/R360S, K60R/Q280S/R360S, A74V/R200A/Q339M, D103P, D103P/E106R/R360S, D103P/E111V/E235T/Q280S/R360S, D103P/E111V/E235T/I321V/F324D, E106R, E106R/E111V, E106R/E111V/A322T/D383E/Y386W, E106R/E235T, E106R/E235T/D383E/Y386W, E106R/F324D, E111V, E111V/E235T/Q280S, E111V/A322T/R360S, R200A/N270S/A275K/Q339M, E235T, E235T/Q280S, E235T/Q280S/I321V/A322T/F324D, E235T/Q280S/I321V/F324E/D383E/Y386W, Q267M/N270S/A275K/Q339M/Y347F, Q267M/K272R/A275K, Q280S, Q280S/D383E, I321V/F324R, and R360S/D383E.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4226 and one or more residue differences or residue difference sets as compared to SEQ ID NO: 4226, selected from: 32/103/106/111/322/324, 32/235, 32/235/386, 32/321/324/360, 32/322/324/383/386, 32/324, 60/106/111/235/360, 72/74/200/272/339/347, 103, 103/106/360, 103/111/235/280/360, 103/111/235/321/324, 106, 106/111, 106/111/322/324/386, 106/111/322/383/386, 106/235, 106/235/383/386, 106/324, 111, 111/235/280, 111/322/360, 200/270/275/339, 235, 235/280, 235/280/321/322/324, 267/270/275/339/347, 267/272/275, 280, 280/383, 321/324, and 360/383. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4226 and one or more residue differences or residue difference sets as compared to SEQ ID NO: 4226, selected from: 32P/103P/106R/111V/322T/324E, 32P/235T, 32P/235T/386W, 32P/321V/324D/360S, 32P/322T/324R/383E/386W, 32P/324D, 60R/106R/111V/235T/360S, 72R/74V/200A/272R/339N/347F, 103P, 103P/106R/360S, 103P/111V/235T/280S/360S, 103P/111V/235T/321V/324D, 106R, 106R/111V, 106R/111V/322T/324E/386W, 106R/111V/322T/383E/386W, 106R/235T, 106R/235T/383E/386W, 106R/324D, 111V, 111V/235T/280S, 111V/322T/360S, 200A/270S/275K/339M, 235T, 235T/280S, 235T/280S/321V/322T/324D, 267M/270S/275K/339M/347F, 267M/272R/275K, 280S, 280S/383E, 321V/324R, and 360S/383E. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4226 and one or more residue differences or residue difference sets as compared to SEQ ID NO: 4226, selected from: Q32P/D103P/E106R/E111V/A322T/F324E, Q32P/E235T, Q32P/E235T/Y386W, Q32P/I321V/F324D/R360S, Q32P/A322T/F324R/D383E/Y386W, Q32P/F324D, K60R/E106R/E111V/E235T/R360S, K72R/A74V/R200A/K272R/Q339N/Y347F, D103P, D103P/E106R/R360S, D103P/E111V/E235T/Q280S/R360S, D103P/E111V/E235T/I321V/F324D, E106R, E106R/E111V, E106R/E111V/A322T/F324E/Y386W, E106R/E111V/A322T/D383E/Y386W, E106R/E235T, E106R/E235T/D383E/Y386W, E106R/F324D, E111V, E111V/E235T/Q280S, E111V/A322T/R360S, R200A/N270S/A275K/Q339M, E235T, E235T/Q280S, E235T/Q280S/I321V/A322T/F324D, Q267M/N270S/A275K/Q339M/Y347F, Q267M/K272R/A275K, Q280S, Q280S/D383E, I321V/F324R, and R360S/D383E.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4226 and one or more residue differences or residue difference sets as compared to SEQ ID NO: 4226, selected from: 48, 50, 53, 57, 58, 63, 65, 68, 69, 73, 75, 85, 94, 104, 105, 123, 135, 140, 141, 166, 167, 180, 184, 185, 187, 192, 209, 210, 217, 220, 239, 244, 253, 256, 260, 261, 265/346, 266, 267, 268, 273, 274, 275, 282, 284, 325, 344, 349, 350, 352, 353, 360, 361, 365, 371, 378, and 386. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4226 and one or more residue differences or residue difference sets as compared to SEQ ID NO: 4226, selected from: 48I, 50E, 53D, 57L, 58D, 63D, 63G, 65G, 65N, 65R, 65V, 65W, 68M, 68R, 69A, 69H, 69M, 69T, 73K, 75G, 75I, 75V, 85I, 94V, 104I, 105L, 123N, 135I, 140I, 141R, 166N, 167R, 180G, 180R, 180V, 184D, 185F, 185R, 187D, 192L, 192Q, 209A, 210L, 210T, 210V, 217R, 220I, 220Q, 220R, 239V, 244L, 253I, 256G, 256Q, 260N, 261A, 261K, 261R, 265K/346M, 266R, 267K, 286I, 273G, 274W, 275K, 275R, 275V, 282M, 284C, 284S, 325S, 344I, 344M, 349A, 349H, 349R, 349V, 349W, 349Y, 350I, 350R, 350V, 350Y, 352K, 353C, 360G, 360Q, 361C, 365Q, 371G, 371K, 371M, 371T, 371V, 378V, and 386F. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4226 and one or more residue differences or residue difference sets as compared to SEQ ID NO: 4226, selected from: F48I, D50E, E53D, E57L, N58D, E63D, E63G, L65G, L65N, L65R, L65V, L65W, C68M, C68R, L69A, L69H, L69M, L69T, R73K, A75G, A75I, A75V, V85I, L94V, V104I, I105L, D123N, V135I, V140I, K141R, S166N, K167R, A180G, A180R, A180V, S184D, K185F, K185R, E187D, T192L, T192Q, T209A, I210L, I210T, I210V, G217R, M220I, M220Q, M220R, L239V, V244L, L253I, E256G, E256Q, E260N, S261A, S261K, S261R, E265K/R346M, G266R, Q267K, L268I, P273G, D274W, A275K, A275R, A275V, C282M, A284C, A284S, E325S, T344I, T344M, E349A, E349H, E349R, E349V, E349W, E349Y, E350I, E350R, E350V, E350Y, R352K, D353C, R360G, R360Q, L361C, K365Q, S371G, S371K, S371M, S371T, S371V, I378V, and Y386F.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4226 and one or more residue differences or residue difference sets as compared to SEQ ID NO: 4226, selected from: 48, 50, 53, 56, 57, 58, 63, 65, 68, 69, 70, 73, 75, 105, 135, 140, 141, 166, 167, 175, 176, 180, 185, 187, 192, 210, 217, 220, 239, 244, 256, 260, 261, 266, 268, 271, 274, 275, 280, 282, 284, 325, 330, 344, 346, 349, 350, 352, 358, 360, 361, 369, 371, 378, 384, and 386. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4226 and one or more residue differences or residue difference sets as compared to SEQ ID NO: 4226, selected from: 48I, 48L, 50E, 53D, 56V, 57L, 58D, 63D, 63G, 65A, 65G, 65N, 65R, 65V, 68M, 68Q, 68R, 68V, 69A, 69G, 69H, 69M, 69T, 70K, 70N, 70R, 73K, 75G, 75I, 75M, 75V, 105L, 135I, 140I, 141R, 166N, 167R, 175H, 176H, 180G, 180R, 180V, 185F, 185M, 185R, 187D, 192L, 192Q, 210L, 210V, 217R, 220I, 220Q, 220R, 239V, 244L, 256G, 256Q, 256S, 260N, 261A, 261H, 261K, 261R, 266R, 286I, 271R, 274G, 275K, 275R, 275V, 280G, 282M, 284C, 284S, 325S, 330T, 344I, 346K, 349A, 349R, 349V, 349W, 349Y, 350C, 350I, 350R, 350V, 350Y, 352K, 358A, 360G, 360K, 360Q, 361C, 369L, 371G, 371K, 371V, 378V, 384V, and 386F. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4226 and one or more residue differences or residue difference sets as compared to SEQ ID NO: 4226, selected from: F48I, F48L, D50E, E53D, A56V, E57L, N58D, E63D, E63G, L65A, L65G, L65N, L65R, L65V, C68M, C68Q, C68R, C68V, L69A, L69G, L69H, L69M, L69T, E70K, E70N, E70R, R73K, A75G, A75I, A75M, A75V, I105L, V135I, V140I, K141R, S166N, K167R, Y175H, Y176H, A180G, A180R, A180V, K185F, K185M, K185R, E187D, T192L, T192Q, I210L, I210V, G217R, M220I, M220Q, M220R, L239V, V244L, E256G, E256Q, E256S, E260N, S261A, S261H, S261K, S261R, G266R, L268I, P271R, D274G, A275K, A275R, A275V, Q280G, C282M, A284C, A284S, E325S, A330T, T344I, R346K, E349A, E349R, E349V, E349W, E349Y, E350C, E350I, E350R, E350V, E350Y, R352K, N358A, R360G, R360K, R360Q, L361C, F369L, S371G, S371K, S371V, I378V, L384V, and Y386F.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4734 and one or more residue differences or residue difference sets as compared to SEQ ID NO: 4734, selected from: 32, 32/161/193/237/360, 32/162, 32/162/193/267, 32/162/237/265/266, 32/162/302, 32/302, 53/163/201/325/329, 53/200/201/325/329, 53/201, 53/201/275/280, 154, 154/166, 154/166/210/296, 154/339, 156/210/339, 161/162, 161/237, 162, 162/193/232/267/302/360, 162/237/265/266/267/302, 162/265, 162/267/360, 166/210, 166/296, 166/346/347, 167/210/346/

349, 193/267, 201/371, 210/339, 237, 237/265, 237/266/360, 237/360, 339, and 371. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4734 and one or more residue differences or residue difference sets as compared to SEQ ID NO: 4734, selected from: 32P, 32P/161R/193A/237P/360S, 32P/162F, 32P/162F/193A/267M, 32P/162F/237P/265P/266Q, 32P/162F/302L, 32P/302L, 53T/163M/201R/325H/329F, 53T/200A/201R/325H/329F, 53T/201R, 53T/201R/275K/280S, 154R, 154R/166N, 154R/166T/210L/296R, 154R/339M, 156V/210L/339M, 161G/162F, 161G/237P, 161R/162F, 162F/193A/232N/267M/302L/360S, 162F/265P, 162F/267M/3605, 162R, 162R/237P/265P/266Q/267M/302L, 166N/210L, 166N/296R, 166N/346W/347F, 167R/210L/346W/3495, 193A/267M, 201R/371R, 210L/339M, 237P, 237P/265P, 237P/266Q/3605, 237P/3605, 339M, and 371R. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4734 and one or more residue differences or residue difference sets as compared to SEQ ID NO: 4734, selected from: Q32P, Q32P/K161R/L193A/D237P/R360S, Q32P/S162F, Q32P/S162F/L193A/Q267M, Q32P/S162F/D237P/E265P/G266Q, Q32P/S162F/K302L, Q32P/K302L, E53T/L163M/T201R/E325H/Y329F, E53T/R200A/T201R/E325H/Y329F, E53T/T201R, E53T/T201R/A275K/Q280S, V154R, V154R/S166N, V154R/S166T/I210L/S296R, V154R/Q339M, E156V/I210L/Q339M, K161G/S162F, K161G/D237P, K161R/S162F, S162F/L193A/G232N/Q267M/K302L/R360S, S162F/E265P, S162F/Q267M/R360S, S162R, S162R/D237P/E265P/G266Q/Q267M/K302L, S166N/I210L, S166N/S296R, S166N/R346W/Y347F, K167R/I210L/R346W/E349S, L193A/Q267M, T201R/S371R, I210L/Q339M, D237P, D237P/E265P, D237P/G266Q/R360S, D237P/R360S, Q339M, and S371R.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4734 and one or more residue differences or residue difference sets as compared to SEQ ID NO: 4734, selected from: 32, 32/162, 32/162/193, 32/162/193/267, 32/162/237/265/266, 32/162/302, 53/163/201/325/329, 53/200/201/325/329, 53/201, 53/201/275/280, 53/201/371, 82/154/296, 154, 154/166, 154/166/210/296, 154/166/346/347, 154/166/347, 154/167/210/347/349, 154/296/347, 154/339, 154/347, 156/166/167, 161/162, 161/237, 162, 162/193/232/267/302/360, 162/237/265/266/267/302, 162/265, 162/267/360, 163/201, 164/275/280, 166/210, 166/296, 166/346/347, 193/267, 201/371, 210/339, 237, 237/265, and 339. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4734 and one or more residue differences or residue difference sets as compared to SEQ ID NO: 4734, selected from: 32P, 32P/162F, 32P/162F/193A/267M, 32P/162F/237P/265P/266Q, 32P/162F/302L, 32P/162R/193A, 53T/163M/201R/325H/329F, 53T/200A/201R/325H/329F, 53T/201R, 53T/201R/275K/2805, 53T/201R/371R, 82S/154R/296R, 154R, 154R/166N, 154R/166N/3465/347F, 154R/166N/347F, 154R/166T/210L/296R, 154R/167R/210L/347F/3495, 154R/296R/347F, 154R/339M, 154R/347F, 156V/166T/167R, 161G/237P, 161R/162F, 162F/193A/232N/267M/302L/3605, 162F/265P, 162F/267M/3605, 162R, 162R/237P/265P/266Q/267M/302L, 163M/201R, 164M/275K/2805, 166N/210L, 166N/296R, 166N/346W/347F, 193A/267M, 201R/371R, 210L/339M, 237P, 237P/265P, and 339M. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 4734 and one or more residue differences or residue difference sets as compared to SEQ ID NO: 4734, selected from: Q32P, Q32P/S162F, Q32P/S162F/L193A/Q267M, Q32P/S162F/D237P/E265P/G266Q, Q32P/S162F/K302L, Q32P/S162R/L193A, E53T/L163M/T201R/E325H/Y329F, E53T/R200A/T201R/E325H/Y329F, E53T/T201R, E53T/T201R/A275K/Q280S, E53T/T201R/S371R, P82S/V154R/S296R, V154R, V154R/S166N, V154R/S166N/R346S/Y347F, V154R/S166N/Y347F, V154R/S166T/I210L/S296R, V154R/K167R/I2I0L/Y347F/E349S, V154R/S296R/Y347F, V154R/Q339M, V154R/Y347F, E156V/S166T/K167R, K161G/D237P, K161R/S162F, S162F/L193A/G232N/Q267M/K302L/R360S, S162F/E265P, S162F/Q267M/R360S, S162R, S162R/D237P/E265P/G266Q/Q267M/K302L, L163M/T201R, K164M/A275K/Q280S, S166N/I210L, S166N/S296R, S166N/R346W/Y347F, L193A/Q267M, T201R/S371R, I210L/Q339M, D237P, D237P/E265P, and Q339M.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5052 and one or more residue differences or residue difference sets as compared to SEQ ID NO: 5052, selected from: 32, 32/72/339, 32/72/339/360, 32/140/141/261/360, 32/140/339, 32/140/360, 32/141/180/244, 32/180/261/339, 32/244/261, 32/339, 53/73/75/237/239, 69/220, 69/339, 70, 70/72/180/360, 70/140/141/339, 70/360, 72/256/360, 72/360, 75/237/350, 140/141/256/261/339, 140/180/244/261/339/360, 141/244/261/360, 141/244/360, 141/256/339/360, 141/261/339, 141/360, 155/220/325/339, 180/339, 220, 220/339, 256/360, and 261. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5052 and one or more residue differences or residue difference sets as compared to SEQ ID NO: 5052, selected from: 32P, 32P/72R/339M, 32P/72R/339M/360G, 32P/140I/141R/261R/360S, 32P/140I/339M, 32P/140I/360G, 32P/141R/180R/244L, 32P/180R/261R/339M, 32P/244L/261R, 32P/339M, 53T/73K/75V/237P/239V, 69A/220R, 69A/339M, 70R, 70R/72R/180R/360G, 70R/140I/141R/339M, 70R/360S, 72R/256Q/3605, 72R/360G, 75I/237P/350R, 140I/141R/256Q/261R/339M, 140I/180R/244L/261R/339M/360G, 141R/244L/261R/360S, 141R/244L/360S, 141R/256Q/339M/360G, 141R/261R/339M, 141R/360S, 155Y/220R/3255/339M, 180R/339M, 220R, 220R/339M, 256Q/3605, and 261R. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5052 and one or more residue differences or residue difference sets as compared to SEQ ID NO: 5052, selected from: Q32P, Q32P/K72R/Q339M, Q32P/K72R/Q339M/R360G, Q32P/V140I/K141R/S261R/R360S, Q32P/V140I/Q339M, Q32P/V140I/R360G, Q32P/K141R/A180R/V244L, Q32P/A180R/S261R/Q339M, Q32P/V244L/S261R, Q32P/Q339M, E53T/R73K/A75V/D237P/L239V, L69A/M220R, L69A/Q339M, E70R, E70R/K72R/A180R/R360G, E70R/V140I/K141R/Q339M, E70R/R360S, K72R/E256Q/R360S, K72R/R360G, A75I/D237P/E350R, V140I/K141R/E256Q/S261R/Q339M, V140I/A180R/V244L/S261R/Q339M/R360G, K141R/V244L/S261R/R360S, K141R/V244L/R360S, K141R/E256Q/Q339M/R360G, K141R/S261R/Q339M, K141R/R360S, E155Y/M220R/E325S/Q339M, A180R/Q339M, M220R, M220R/Q339M, E256Q/R360S, and S261R.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5052 and one or more residue differences or residue difference sets as compared to SEQ ID NO: 5052, selected from: 32/72/339, 32/72/339/360, 32/140/141/261/360, 32/140/339, 32/180/261/339, 32/244/261, 32/339, 53/73/75/237/239, 56/75/154/156/192/239/280/282, 56/75/192/239, 56/192/282/350, 65/220/339, 69/220, 69/339, 70/72, 70/72/140/244/261/339, 70/72/141/244, 70/261/339/360, 72/180/244/339, 72/256/360, 72/360, 140/141/256/261/339, 140/180/244/261/339/360, 141/244/360, 141/256/339/360, 141/261/339, 141/360, 150/244/261/360, 154/156/282/350, 155/220/325/339, 180/339, 220, 220/339, 244/256/261/339/360, 325, 325/339, and 339. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5052 and one or more residue differences or residue difference sets as compared to SEQ ID NO: 5052, selected from: 32P/72R/339M, 32P/72R/339M/360G, 32P/140I/141R/261R/360S, 32P/140I/339M, 32P/180R/261R/339M, 32P/244L/261R, 32P/339M, 53T/73K/75V/237P/239V, 56V/75I/154V/156V/192L/239V/280G/282M, 56V/75V/192L/239V, 56V/192Q/282M/350I, 65R/220Q/339M, 69A/220R, 69A/339M, 70R/72R, 70R/72R/140I/244L/261R/339M, 70R/72R/141R/244L, 70R/261R/339M/360S, 72R/180R/244L/339M, 72R/256Q/360S, 72R/360G, 140I/141R/256Q/261R/339M, 140I/180R/244L/261R/339M/360G, 141R/244L/360S, 141R/256Q/339M/360G, 141R/261R/339M, 141R/360S, 150D/244L/261R/360S, 154V/156V/282M/350I, 155Y/220R/325S/339M, 180R/339M, 220R, 220R/339M, 244L/256Q/261R/339M/360S, 325S, 325S/339M, and 339M. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5052 and one or more residue differences or residue difference sets as compared to SEQ ID NO: 5052, selected from: Q32P/K72R/Q339M, Q32P/K72R/Q339M/R360G, Q32P/V140I/K141R/S261R/R360S, Q32P/V140I/Q339M, Q32P/A180R/S261R/Q339M, Q32P/V244L/S261R, Q32P/Q339M, E53T/R73K/A75V/D237P/L239V, A56V/A75I/R154V/E156V/T192L/L239V/Q280G/C282M, A56V/A75V/T192L/L239V, A56V/T192Q/C282M/E350I, L65R/M220Q/Q339M, L69A/M220R, L69A/Q339M, E70R/K72R, E70R/K72R/V140I/V244L/S261R/Q339M, E70R/K72R/K141R/V244L, E70R/S261R/Q339M/R360S, K72R/A180R/V244L/Q339M, K72R/E256Q/R360S, K72R/R360G, V140I/K141R/E256Q/S261R/Q339M, V140I/A180R/V244L/S261R/Q339M/R360G, K141R/V244L/R360S, K141R/E256Q/Q339M/R360G, K141R/S261R/Q339M, K141R/R360S, G150D/V244L/S261R/R360S, R154V/E156V/C282M/E350I, E155Y/M220R/E325S/Q339M, A180R/Q339M, M220R, M220R/Q339M, V244L/E256Q/S261R/Q339M/R360S, E325S, E325S/Q339M, and Q339M.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5152 and one or more residue differences or residue difference sets as compared to SEQ ID NO: 5152, selected from: 53, 53/237, 65/140, 65/140/192/193, 65/140/192/193/302, 65/193, 140/192/193/302, 140/193/302, 180, 192/193, 239, and 302. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5152 and one or more residue differences or residue difference sets as compared to SEQ ID NO: 5152, selected from: 53T, 53T/237P, 65R/140I, 65R/140I/192L/193D, 65R/140I/192L/193D/302L, 65R/193D, 140I/192L/193D/302L, 140I/193D/302L, 180V, 192L/193D, 239V, and 302L. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5152 and one or more residue differences or residue difference sets as compared to SEQ ID NO: 5152, selected from: E53T, E53T/D237P, L65R/V140I, L65R/V140I/T192L/L193D, L65R/V140I/T192L/L193D/K302L, L65R/L193D, V140I/T192L/L193D/K302L, V140I/L193D/K302L, A180V, T192L/L193D, L239V, and K302L.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5252 and one or more residue differences or residue difference sets as compared to SEQ ID NO: 5252, selected from: 48/53/237/239, 48/256/261, 140, 141/261, 162, 220, 220/349, 261, 302, and 350. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5252 and one or more residue differences or residue difference sets as compared to SEQ ID NO: 5252, selected from: 48I/53T/237P/239V, 48I/256G/261R, 140I, 141R/261R, 162F, 220Q, 220Q/349V, 261R, 302L, and 350Y. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5252 and one or more residue differences or residue difference sets as compared to SEQ ID NO: 5252, selected from: F48I/E53T/D237P/L239V, F48I/E256G/S261R, V140I, K141R/S261R, S162F, M220Q, M220Q/E349V, S261R, K302L, and E350Y.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5296 and one or more residue differences or residue difference sets as compared to SEQ ID NO: 5296, selected from: 65, 65/184/187, 82/184/220/386, 154, 154/184, 154/187/220/350/386, 154/293, 154/350, 154/386, 184/187, 184/293, 187/220/350, 187/293, 220, 220/293, 293, 293/350, 293/350/386, 350, and 386. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5296 and one or more residue differences or residue difference sets as compared to SEQ ID NO: 5296, selected from: 65R, 65R/184T/187D, 82S/184T/220Q/386F, 154L, 154L/184T, 154L/187D/220Q/350I/386F, 154L/293T, 154L/350I, 154L/386F, 184T/187D, 184T/293T, 187D/220Q/350R, 187D/293T, 220Q, 220Q/293T, 293T, 293T/350R, 293T/350R/386F, 350R, and 386F. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5296 and one or more residue differences or residue difference sets as compared to SEQ ID NO: 5296, selected from: L65R, L65R/S184T/E187D, P82S/S184T/M220Q/Y386F, R154L, R154L/S184T, R154L/E187D/M220Q/E350I/Y386F, R154L/V293T, R154L/E350I, R154L/Y386F, S184T/E187D, S184T/V293T, E187D/M220Q/E350R, E187D/V293T, M220Q, M220Q/V293T, V293T, V293T/E350R, V293T/E350R/Y386F, E350R, and Y386F.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5296 and one or more residue differences or residue difference sets as compared to SEQ ID NO: 5296, selected from: 157, 160, 186, 188, 189, 190, 191, 192, 193, 194, 195, 196, 197, 198, 199, 200, 201, 202, 203, 204, 206, 209, 210, 211, 227, 229, 230, 233, 234, 235, 236, 237/381, 238, 241, 242, 243, 247, 253, 258, 260, 267, 272, 278, 282, 286, 288, 290, 292, 297, 298, 299, 327, 331, 368, 373, and 381. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5296 and one or more residue differences or residue difference sets as compared to SEQ ID NO: 5296, selected from: 157V, 160F, 160M, 160V, 160Y, 186A, 186L, 186V, 188K, 188M, 188V, 189A, 189L, 189R, 190I, 190M, 190S, 191L, 191M, 192T, 192V, 192Y, 193E, 193G, 193Q, 193R, 194F, 194R, 194T, 194W, 195I, 195L, 196G, 196T, 197Q, 198V, 199M, 199W, 200L, 200M, 200T, 200W, 201S, 201Y, 202W, 203D, 203I, 203L, 203R, 204G, 206H, 209R, 210A, 210C, 210T, 211V, 227V, 229G, 229R, 230N, 233L, 233S, 233W, 234G, 234Q, 234R, 234V, 235H, 235L, 236P, 237G/381W, 238G, 238L, 238R, 238W, 241A, 241E, 241L, 241R, 241S, 241W, 242V, 243M, 243S, 247V, 253V, 258C, 258L, 258V, 260A, 260G, 260M, 267T, 272R, 272S, 278S, 282T, 286A, 286C, 286V, 288A, 288K, 288Y, 290P, 292R, 297F, 297G, 297P, 297V, 298F, 298R, 298T, 299M, 299N, 299R, 299S, 299V, 299Y, 327H, 331K, 368G, 368Q, 368S, 368T, 368V, 373Q, 381L, and 381V. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5296 and one or more residue differences or residue difference sets as compared to SEQ ID NO: 5296, selected from: A157V, S160F, S160M, S160V, S160Y, E186A, E186L, E186V, A188K, A188M, A188V, D189A, D189L, D189R, A190I, A190M, A190S, V191L, V191M, L192T, L192V, L192Y, D193E, D193G, D193Q, D193R, I194F, I194R, I194T, I194W, V195I, V195L, K196G, K196T, E197Q, T198V, V199M, V199W, R200L, R200M, R200T, R200W, T201S, T201Y, V202W, S203D, S203I, S203L, S203R, P204G, A206H, T209R, I210A, I210C, I210T, A211V, L227V, T229G, T229R, I230N, R233L, R233S, R233W, P234G, P234Q, P234R, P234V, T235H, T235L, D236P, D237G/H381W, E238G, E238L, E238R, E238W, H241A, H241E, H241L, H241R, H241S, H241W, K242V, V243M, V243S, L247V, L253V, I258C, I258L, I258V, E260A, E260G, E260M, Q267T, K272R, K272S, N278S, C282T, L286A, L286C, L286V, L288A, L288K, L288Y, R290P, K292R, A297F, A297G, A297P, A297V, V298F, V298R, V298T, G299M, G299N, G299R, G299S, G299V, G299Y, F327H, L331K, I368G, I368Q, I368S, I368T, I368V, D373Q, H381L, and H381V.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5296 and one or more residue differences or residue difference sets as compared to SEQ ID NO: 5296, selected from: 160, 186, 188, 189, 190, 191, 192, 193, 194, 195, 196, 197, 199, 200, 201, 202, 203, 204, 209, 210, 211, 229, 230, 233, 234, 235, 236, 237/381, 238, 241, 243, 244, 247, 253, 260, 278, 286, 288, 292, 297, 298, 299, 327, 331, 368, 373, and 381. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5296 and one or more residue differences or residue difference sets as compared to SEQ ID NO: 5296, selected from: 160F, 160V, 160Y, 186A, 186L, 186V, 188K, 188M, 189A, 189R, 190I, 190M, 190Q, 190S, 191L, 191M, 192V, 192Y, 193E, 193G, 193Q, 194F, 1951, 196E, 196T, 197S, 199M, 199W, 200L, 200T, 200W, 201M, 202L, 203G, 204C, 204L, 209R, 209S, 210A, 210C, 210T, 211V, 229R, 229V, 230N, 233L, 234Q, 234V, 235H, 236R, 237G/381W, 238L, 238R, 238W, 241R, 241S, 243M, 243S, 244S, 247F, 253V, 260A, 260G, 278S, 286C, 286V, 288A, 292R, 297V, 298F, 298T, 299N, 299S, 327H, 331K, 368E, 368S, 368T, 373Q, 373R, and 381L. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5296 and one or more residue differences or residue difference sets as compared to SEQ ID NO: 5296, selected from: S160F, S160V, S160Y, E186A, E186L, E186V, A188K, A188M, D189A, D189R, A190I, A190M, A190Q, A190S, V191L, V191M, L192V, L192Y, D193E, D193G, D193Q, I194F, V1951, K196E, K196T, E197S, V199M, V199W, R200L, R200T, R200W, T201M, V202L, S203G, P204C, P204L, T209R, T209S, I210A, I210C, I210T, A211V, T229R, T229V, I230N, R233L, P234Q, P234V, T235H, D236R, D237G/H381W, E238L, E238R, E238W, H241R, H241S, V243M, V243S, V244S, L247F, L253V, E260A, E260G, N278S, L286C, L286V, L288A, K292R, A297V, V298F, V298T, G299N, G299S, F327H, L331K, I368E, I368S, I368T, D373Q, D373R, and H381L.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5628 and one or more residue differences or residue difference sets as compared to SEQ ID NO: 5628, selected from: 26, 26/60/200, 26/60/200/203/292, 26/60/203/229/234/290, 26/200/203, 26/200/203/229, 26/200/290, 26/203/234/290/292, 60, 60/200/203/290, 60/203, 157/162, 157/368, 162/242/368, 200, 200/203/229/234, 200/203/290, 200/206, 200/234/290, 200/290/292/360, 203, 203/229, 229/360, and 360. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5628 and one or more residue differences or residue difference sets as compared to SEQ ID NO: 5628, selected from: 26T, 26T/60R/200W, 26T/60R/200W/203D/292R, 26T/60R/203D/229R/234G/290N, 26T/200W/203D, 26T/200W/203D/229R, 26T/200W/290N, 26T/203D/234G/290N/292R, 60R, 60R/200W/203D/290N, 60R/203D, 157V/162F, 157V/368Q, 162F/242N/368T, 200W, 200W/203D/229R/234G, 200W/203D/290N, 200W/206P, 200W/234G/290N, 200W/290N/292R/360S, 203D, 203D/229R, 229R/360S, and 360S. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5628 and one or more residue differences or residue difference sets as compared to SEQ ID NO: 5628, selected from: I26T, I26T/K60R/R200W, I26T/K60R/R200W/S203D/K292R, I26T/K60R/S203D/T229R/P234G/R290N, I26T/R200W/S203D, I26T/R200W/S203D/T229R, I26T/R200W/R290N, I26T/S203D/P234G/R290N/K292R, K60R, K60R/R200W/S203D/R290N, K60R/S203D, A157V/S162F, A157V/I368Q, S162F/K242N/I368T, R200W, R200W/S203D/T229R/P234G, R200W/S203D/R290N, R200W/A206P, R200W/P234G/R290N, R200W/R290N/K292R/G360S, S203D, S203D/T229R, T229R/G360S, and G360S.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5628 and one or more residue differences or residue difference sets as compared to SEQ ID NO: 5628, selected from: 26, 26/60/200, 26/60/200/203/229/234/267, 26/60/200/203/229/267, 26/60/200/203/229/267/290, 26/60/200/203/234/267, 26/60/200/203/292, 26/60/200/234/290, 26/60/203/229/234/290, 26/60/229/267, 26/60/290, 26/200, 26/200/203, 26/200/203/229, 26/200/290, 26/229/234/360, 53/157/278/327/331, 53/162/327/331/368, 60, 60/200/203/290, 60/200/229/234, 60/200/234, 60/200/234/267/290/292, 60/200/234/290, 60/203, 157/162, 157/162/241/242/260, 157/162/241/242/327/331, 157/162/241/278/331/368, 157/162/241/331, 157/162/242/260/331, 157/162/331, 157/327/331, 162/241/278/327/331, 162/241/331, 162/242/368, 200, 200/203/229/234, 200/203/290, 200/206, 200/234/290, 200/290/292/360, 210/211/242, 229/360, 241/242/368, 242/331, 260/327, 260/331, 260/368, 331, 360, and 368. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5628 and one or more residue differences or residue difference sets as compared to SEQ ID NO: 5628, selected from: 26T, 26T/60R/200W, 26T/60R/200W/203D/229R/234G/267K, 26T/60R/200W/203D/229R/267K, 26T/60R/200W/203D/229R/267K/290N, 26T/60R/200W/203D/234G/267K, 26T/60R/200W/203D/292R, 26T/60R/200W/234G/290N, 26T/60R/203D/229R/234G/290N, 26T/60R/229R/267K, 26T/60R/290N, 26T/200W, 26T/200W/203D, 26T/200W/203D/229R, 26T/200W/290N, 26T/229R/234G/360S, 53T/157V/278G/327H/331K, 53T/162F/327H/331N/368Q, 60R, 60R/200W/203D/290N, 60R/200W/229R/234G, 60R/200W/234G, 60R/200W/234G/267K/290N/292R, 60R/200W/234G/290N, 60R/203D, 157L/162F/241S/331K, 157V/162F, 157V/162F/241S/242N/260A, 157V/162F/241S/242N/327H/331K, 157V/162F/241S/278G/331K/368Q, 157V/162F/242N/260A/331K, 157V/162F/331K, 157V/327H/331K, 162F/241S/278G/327H/331K, 162F/241S/331K, 162F/242N/368T, 200W, 200W/203D/229R/234G, 200W/203D/290N, 200W/206P, 200W/234G/290N, 200W/290N/292R/360S, 210T/211V/242N, 229R/360S, 241S/242N/368Q, 242N/331K, 260A/327H, 260A/331K, 260A/368Q, 331K, 360S, and 368Q. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5628 and one or more residue differences or residue difference sets as compared to SEQ ID NO: 5628, selected from: I26T, I26T/K60R/R200W, I26T/K60R/R200W/S203D/T229R/P234G/Q267K, I26T/K60R/R200W/S203D/T229R/Q267K, I26T/K60R/R200W/S203D/T229R/Q267K/R290N, I26T/K60R/R200W/S203D/P234G/Q267K, I26T/K60R/R200W/S203D/K292R, I26T/K60R/R200W/P234G/R290N, I26T/K60R/S203D/T229R/P234G/R290N, I26T/K60R/T229R/Q267K, I26T/K60R/R290N, I26T/R200W, I26T/R200W/S203D, I26T/R200W/S203D/T229R, I26T/R200W/R290N, I26T/T229R/P234G/G360S, E53T/A157V/N278G/F327H/L331K, E53T/S162F/F327H/L331N/I368Q, K60R, K60R/R200W/S203D/R290N, K60R/R200W/T229R/P234G, K60R/R200W/P234G, K60R/R200W/P234G/Q267K/R290N/K292R, K60R/R200W/P234G/R290N, K60R/S203D, A157L/S162F/H241S/L331K, A157V/S162F, A157V/S162F/H241S/K242N/E260A, A157V/S162F/H241S/K242N/F327H/L331K, A157V/S162F/H241S/N278G/L331K/I368Q, A157V/S162F/K242N/E260A/L331K, A157V/S162F/L331K, A157V/F327H/L331K, S162F/H241S/N278G/F327H/L331K, S162F/H241S/L331K, S162F/K242N/I368T, R200W, R200W/S203D/T229R/P234G, R200W/S203D/R290N, R200W/A206P, R200W/P234G/R290N, R200W/R290N/K292R/G360S, I210T/A211V/K242N, T229R/G360S, H241S/K242N/I368Q, K242N/L331K, E260A/F327H, E260A/L331K, E260A/I368Q, L331K, G360S, and I368Q.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5628 and one or more residue differences or residue difference sets as compared to SEQ ID NO: 5628, selected from: 217, 226, 239, 256, 264, 273, 275, 315, 325, 328, 339, 342, 342/363, 344, 345, 346, 350, 351, 352, 353, 361, 363, 364, 365, 366, 367, 371, 374, 376, 380, 383, and 388. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5628 and one or more residue differences or residue difference sets as compared to SEQ ID NO: 5628, selected from: 217L, 226M, 226S, 226T, 239K, 256S, 264E, 264L, 264M, 273S, 275E, 275R, 275V, 315A, 325N, 325T, 328H, 339F, 342A, 342C, 342C/363S, 342G, 342L, 342N, 342S, 342T, 342W, 342Y, 3441, 345W, 346T, 346V, 346W, 350Q, 3511, 351M, 351V, 352K, 352Q, 353C, 353M, 353N, 361M, 363H, 364V, 365S, 366N, 367K, 367Y, 371C, 374A, 374R, 376L, 376M, 380R, 380S, 380V, 383Q, and 388Q. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5628 and one or more residue differences or residue difference sets as compared to SEQ ID NO: 5628, selected from: G217L, L226M, L226S, L226T, L239K, G256S, V264E, V264L, V264M, P273S, Q275E, Q275R, Q275V, V315A, E325N, E325T, A328H, M339F, R342A, R342C, R342C/D363S, R342G, R342L, R342N, R342S, R342T, R342W, R342Y, T3441, R345W, R346T, R346V, R346W, E350Q, E3511, E351M, E351V, R352K, R352Q, D353C, D353M, D353N, L361M, D363H, L364V, K365S, K366N, G367K, G367Y, S371C, S374A, S374R, E376L, E376M, G380R, G380S, G380V, D383Q, and E388Q.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5628 and one or more residue differences or residue difference sets as compared to SEQ ID NO: 5628, selected from: 113/355, 134, 169/390, 217, 226, 239, 256, 264, 265, 271, 275, 313, 314, 315, 321, 325, 328, 332, 339, 342, 342/363, 344, 345, 346, 348, 349, 350, 351, 352, 353, 354, 356, 360, 361, 362, 363, 364, 365, 366, 367, 369, 370, 371, 374, 376, 377, 378, 380, 382, 383, 384, 385, 386, 388, and 391. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5628 and one or more residue differences or residue difference sets as compared to SEQ ID NO: 5628, selected from: 113G/3555, 134N, 169R/390P, 217F, 217H, 217L, 217S, 217V, 217Y, 226S, 226T, 239Q, 239Y, 256S, 264E, 264L, 264M, 265A, 265S, 265Y, 271S, 275E, 275R, 275V, 313G, 314C, 315A, 315T, 321E, 321Q, 325G, 325P, 325T, 328E, 328H, 328V, 3321, 332T, 339A, 339F, 339G, 342C, 342C/3635, 342K, 342L, 342N, 342T, 342W, 342Y, 344S, 345W, 346T, 346W, 348S, 349G, 349T, 350S, 351A, 351G, 351I, 351M, 351R, 351S, 351T, 351V, 352G, 352K, 352Q, 352S, 352T, 352V, 353C, 353I, 353M, 353N, 353R, 353Y, 354A, 354I, 354Q, 354S, 356C, 356V, 360M, 361A, 361F, 361M, 362W, 363H, 363L, 363S, 364G, 364P, 365A, 365C, 365E, 365G, 365L, 365S, 365V, 365Y, 366E, 366G, 366N, 366S, 366T, 367D, 367K, 367L, 367Y, 369L, 369N, 369S, 370C, 370F, 370M, 370Q, 370R, 370S, 370V, 370W, 371C, 371G, 374A, 374E, 374L, 374R, 374W, 376G, 376L, 376M, 377A, 377R, 377T, 378A, 378C, 378L, 378V, 380R, 380S, 380V, 382V, 383A, 383E, 383I, 383K, 383N, 383Q, 383T, 383V, 383W, 383Y, 384C, 384M, 384V, 385H, 385L, 385R, 385V, 386I, 386L, 386T, 386V, 388D, 388G, 388Q, 388Y, 391G, 391L, 391V, 391W, and 391Y. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5628 and one or more residue differences or residue difference sets as compared to SEQ ID NO: 5628, selected from: E113G/L355S, S134N, Q169R/W390P, G217F, G217H, G217L, G217S, G217V, G217Y, L226S, L226T, L239Q, L239Y, G256S, V264E, V264L, V264M, E265A, E265S, E265Y, P271S, Q275E, Q275R, Q275V, K313G, A314C, V315A, V315T, V321E, V321Q, E325G, E325P, E325T, A328E, A328H, A328V, L332I, L332T, M339A, M339F, M339G, R342C, R342C/D363S, R342K, R342L, R342N, R342T, R342W, R342Y, T344S, R345W, R346T, R346W, A348S, E349G, E349T, E350S, E351A, E351G, E3511, E351M, E351R, E351S, E351T, E351V, R352G, R352K, R352Q, R352S, R352T, R352V, D353C, D353I, D353M, D353N, D353R, D353Y, M354A, M354I, M354Q, M354S, L356C, L356V, G360M, L361A, L361F, L361M, Y362W, D363H, D363L, D363S, L364G, L364P, K365A, K365C, K365E, K365G, K365L, K365S, K365V, K365Y, K366E, K366G, K366N, K366S, K366T, G367D, G367K, G367L, G367Y, F369L, F369N, F369S, L370C, L370F, L370M, L370Q, L370R, L370S, L370V, L370W, S371C, S371G, S374A, S374E, S374L, S374R, S374W, E376G, E376L, E376M, E377A, E377R, E377T, I378A, I378C, I378L, I378V, G380R, G380S, G380V, L382V, D383A, D383E, D383I, D383K, D383N, D383Q, D383T, D383V, D383W, D383Y, L384C, L384M, L384V, D385H, D385L, D385R, D385V, Y386I, Y386L, Y386T, Y386V, E388D, E388G, E388Q, E388Y, E391G, E391L, E391V, E391W, and E391Y.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5630 and one or more residue differences or residue difference sets as compared to SEQ ID NO: 5630, selected from: 184/188/200/203/211/242, 184/188/200/203/242/297, 184/188/200/203/290/297/368, 184/188/203/290/297, 184/188/211/242/290/368, 184/189, 184/189/206/297/368, 184/189/297, 184/200, 184/206/242/290/297, 184/211, 184/242, 184/242/297/368, 184/290/297, 184/290/368, 188/211, 188/211/242/290/297/368, 192/193/211/242/297/368, 192/193/290/297/368, 193/194, 194, 194/242, 194/242/290, 200, 200/203, 200/203/290/368, 203/206/368, 203/242/290/297/368, 203/297, 206/290, 211, 211/368, 242/290, 242/290/297, 297, and 368. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5630 and one or more residue differences or residue difference sets as compared to SEQ ID NO: 5630, selected from: 184T/188K/200W/203D/211V/242N, 184T/188K/200W/203D/242N/297F, 184T/188K/200W/203D/290N/297F/368T, 184T/188K/203D/290N/297F, 184T/188K/211V/242N/290N/368T, 184T/189A, 184T/189A/206P/297F/368T, 184T/189A/297F, 184T/200W, 184T/206P/242N/290N/297F, 184T/211V, 184T/242N, 184T/242N/297F/368T, 184T/290N/297F, 184T/290N/368T, 188K/211V, 188K/211V/242N/290N/297F/368T, 192V/193G/211V/242N/297F/368T, 192V/193G/290N/297F/368T, 193G/194F, 194F, 194F/242N, 194F/242N/290N, 200W, 200W/203D, 200W/203D/290N/368T, 203D/206P/368T, 203D/242N/290N/297F/368T, 203D/297F, 206P/290N, 211V, 211V/368T, 242N/290N, 242N/290N/297F, 297F, and 368T. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5630 and one or more residue differences or residue difference sets as compared to SEQ ID NO: 5630, selected from: S184T/A188K/R200W/S203D/A211V/K242N, S184T/A188K/R200W/S203D/K242N/A297F, S184T/A188K/R200W/S203D/R290N/A297F/I368T, S184T/A188K/S203D/R290N/A297F, S184T/A188K/A211V/K242N/R290N/I368T, S184T/D189A, S184T/D189A/A206P/A297F/I368T, S184T/D189A/A297F, S184T/R200W, S184T/A206P/K242N/R290N/A297F, S184T/A211V, S184T/K242N, S184T/K242N/A297F/I368T, S184T/R290N/A297F, S184T/R290N/I368T, A188K/A211V, A188K/A211V/K242N/R290N/A297F/I368T, L192V/D193G/A211V/K242N/A297F/I368T, L192V/D193G/R290N/A297F/I368T, D193G/I194F, I194F, I194F/K242N, I194F/K242N/R290N, R200W, R200W/S203D, R200W/S203D/R290N/I368T, S203D/A206P/I368T, S203D/K242N/R290N/A297F/I368T, S203D/A297F, A206P/R290N, A211V, A211V/I368T, K242N/R290N, K242N/R290N/A297F, A297F, and I368T.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5630 and one or more residue differences or residue difference sets as compared to SEQ ID NO: 5630, selected from: 184, 184/188/200/203/211/242, 184/188/200/203/242/297, 184/188/200/203/290/297/368, 184/188/203/290/297, 184/188/211/242/290/368, 184/189, 184/189/206/297/368, 184/200, 184/242, 184/242/297/368, 184/290/297, 184/290/368, 188/211/242/290/297/368, 189/200, 192/193/211/242/297/368, 192/193/290/297/368, 194/242, 200, 200/203, 200/203/290/368, 203/206/368, 203/297, 206/290, 206/297, 211/368, 242/290, 242/290/297, 297, and 368. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5630 and one or more residue differences or residue difference sets as compared to SEQ ID NO: 5630, selected from: 184T, 184T/188K/200W/203D/211V/242N, 184T/188K/200W/203D/242N/297F, 184T/188K/200W/203D/290N/297F/368T, 184T/188K/203D/290N/297F, 184T/188K/211V/242N/290N/368T, 184T/189A, 184T/189A/206P/297F/368T, 184T/200W, 184T/242N, 184T/242N/297F/368T, 184T/290N/297F, 184T/290N/368T, 188K/211V/242N/290N/297F/368T, 189A/200W, 192V/193G/211V/242N/297F/368T, 192V/193G/290N/297F/368T, 194F/242N, 200W, 200W/203D, 200W/203D/290N/368T, 203D/206P/368T, 203D/297F, 206P/290N, 206P/297F, 211V/368T, 242N/290N, 242N/290N/297F, 297F, and 368T. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5630 and one or more residue differences or residue difference sets as compared to SEQ ID NO: 5630, selected from: S184T, S184T/A188K/R200W/S203D/A211V/K242N, S184T/A188K/R200W/S203D/K242N/A297F, S184T/A188K/R200W/S203D/R290N/A297F/I368T, S184T/A188K/S203D/R290N/A297F, S184T/A188K/A211V/K242N/R290N/I368T, S184T/D189A, S184T/D189A/A206P/A297F/I368T, S184T/R200W, S184T/K242N, S184T/K242N/A297F/I368T, S184T/R290N/A297F, S184T/R290N/I368T, A188K/A211V/K242N/R290N/A297F/I368T, D189A/R200W, L192V/D193G/A211V/K242N/A297F/I368T, L192V/D193G/R290N/A297F/I368T, I194F/K242N, R200W, R200W/S203D, R200W/S203D/R290N/I368T, S203D/A206P/I368T, S203D/A297F, A206P/R290N, A206P/A297F, A211V/I368T, K242N/R290N, K242N/R290N/A297F, A297F, and I368T.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5632 and one or more residue differences or residue difference sets as compared to SEQ ID NO: 5632, selected from: 56, 57, 59, 63, 65, 66, 73, 128/296, 140, 144/220, 149, 151, 159, 209/211, 210/211, 219, 219/300, 230, 261, 272, 273, 275, 278, 292, 324, 327, 331, 345, 364, 371, and 373. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5632 and one or more residue differences or residue difference sets as compared to SEQ ID NO: 5632, selected from: 56G, 57M, 59H, 59W, 63G, 65E, 65M, 65N, 65P, 66A, 66G, 66L, 66N, 73G, 73M, 128V/296G, 140T, 144G/220R, 149E, 149I, 149L, 151H, 151K, 151W, 151Y, 159E, 159N, 159Q, 159R, 159S, 209E/211A, 210V/211A, 219E, 219I, 219N, 219S, 2195/300A, 219T, 219V, 230V, 261S, 272A, 272E, 272N, 272R, 272T, 273-, 273E, 273L, 275E, 275L, 278G, 292D, 292G, 292R, 292T, 292Y, 324E, 327A, 327Y, 331E, 331T, 345Q, 345W, 364R, 371F, 371K, 371P, 371T, 373G, 373K, 373Q, 373R, and 373T. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5632 and one or more residue differences or residue difference sets as compared to SEQ ID NO: 5632, selected from: A56G, E57M, Y59H, Y59W, E63G, L65E, L65M, L65N, L65P, Q66A, Q66G, Q66L, Q66N, R73G, R73M, A128V/S296G, V140T, E144G/Q220R, M149E, M1491, M149L, L151H, L151K, L151W, L151Y, A159E, A159N, A159Q, A159R, A159S, T209E/V211A, I210V/V211A, P219E, P2191, P219N, P219S, P219S/T300A, P219T, P219V, I230V, R261S, K272A, K272E, K272N, K272R, K272T, P273-, P273E, P273L, Q275E, Q275L, N278G, K292D, K292G, K292R, K292T, K292Y, D324E, F327A, F327Y, K331E, K331T, R345Q, R345W, L364R, S371F, S371K, S371P, S371T, D373G, D373K, D373Q, D373R, and D373T.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5632 and one or more residue differences or residue difference sets as compared to SEQ ID NO: 5632, selected from: 56, 57, 59, 61, 65, 66, 73, 74/272, 75, 79, 128, 128/296, 134, 140, 144, 145, 149, 151, 155, 156, 157, 158, 159, 200/202/203, 209/211, 210/211, 211, 219, 219/300, 228, 230, 242, 242/244, 261, 262, 270, 272, 273, 275, 278, 292, 319, 322, 324, 327, 339, 344, 345, 364, 371, 373, and 381. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5632 and one or more residue differences or residue difference sets as compared to SEQ ID NO: 5632, selected from: 56G, 57A, 57C, 57M, 59F, 59H, 59L, 59Q, 61M, 61S, 61W, 61Y, 65E, 65M, 65N, 65P, 65T, 66N, 66V, 73G, 74T/272G, 75S, 79R, 128G, 128K, 128S, 128T, 128V/296G, 134C, 134L, 134Q, 140G, 140L, 140M, 140S, 144A, 145L, 149G, 149L, 149T, 1511, 151M, 151P, 151V, 155A, 155K, 155L, 155N, 155P, 155S, 156H, 157T, 158A, 158D, 158G, 158M, 158P, 158S, 159E, 159G, 159H, 159N, 159Q, 159R, 159S, 159T, 200R/202T/203S, 209A/211A, 209E/211A, 209H/211A, 209S/211A, 210V/211A, 211A, 219E, 219G, 219H, 219N, 219R, 219S, 219S/300A, 219T, 219V, 228L, 230A, 230C, 230M, 230S, 230V, 242G, 242K/244T, 242S, 261A, 261G, 261N, 261S, 262E, 262S, 270C, 270Q, 272A, 272N, 272T, 273L, 275E, 275L, 275V, 278G, 278S, 292D, 292G, 292I, 292R, 292T, 292Y, 319F, 322C, 324E, 324G, 324K, 324R, 324S, 327A, 327S, 327Y, 339E, 344L, 345K, 345Q, 364R, 371K, 371P, 371R, 371T, 373G, 373K, 373Q, 373R, 373T, 373V, and 381L. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5632 and one or more residue differences or residue difference sets as compared to SEQ ID NO: 5632, selected from: A56G, E57A, E57C, E57M, Y59F, Y59H, Y59L, Y59Q, F61M, F61S, F61W, F61Y, L65E, L65M, L65N, L65P, L65T, Q66N, Q66V, R73G, A74T/K272G, A75S, K79R, A128G, A128K, A128S, A128T, A128V/S296G, S134C, S134L, S134Q, V140G, V140L, V140M, V140S, E144A, K145L, M149G, M149L, M149T, L151I, L151M, L151P, L151V, E155A, E155K, E155L, E155N, E155P, E155S, E156H, V157T, K158A, K158D, K158G, K158M, K158P, K158S, A159E, A159G, A159H, A159N, A159Q, A159R, A159S, A159T, W200R/V202T/D203S, T209A/V211A, T209E/V211A, T209H/V211A, T209S/V211A, I210V/V211A, V211A, P219E, P219G, P219H, P219N, P219R, P219S, P219S/T300A, P219T, P219V, I228L, I230A, I230C, I230M, I230S, I230V, N242G, N242K/V244T, N242S, R261A, R261G, R261N, R261S, T262E, T262S, N270C, N270Q, K272A, K272N, K272T, P273L, Q275E, Q275L, Q275V, N278G, N278S, K292D, K292G, K292I, K292R, K292T, K292Y, L319F, A322C, D324E, D324G, D324K, D324R, D324S, F327A, F327S, F327Y, M339E, T344L, R345K, R345Q, L364R, S371K, S371P, S371R, S371T, D373G, D373K, D373Q, D373R, D373T, D373V, and H381L.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5636 and one or more residue differences or residue difference sets as compared to SEQ ID NO: 5636, selected from: 65, 65/70/155/209/228, 65/128/209/371/373, 65/151, 65/155/209, 65/155/209/352/353, 65/159, 65/209/219/352/353, 65/209/352/353/371, 65/228/352/353/373, 65/228/371/373, 65/352/353/371, 128/159/209/352/353, 128/209, 128/209/219, 128/209/219/352/353/371, 128/209/228/371, 128/209/371, 128/209/371/373, 128/209/373, 128/338/352/353/373, 151/209, 151/209/371, 151/209/373, 151/228/352/353/373, 151/228/373, 151/352/353, 151/352/353/371/373, 155, 155/209, 155/228/352/353, 159/209/352/353, 208/209, 209, 209/219/352/353/371, 209/219/371, 209/228, 209/352/353/371, 209/371, 209/371/373, 209/373, 219/228, 219/352/353/371/373, 219/371/373, 228, 228/371, 228/371/373, 228/373, 352/353, 352/353/371, 371, 371/373, and 373. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5636 and one or more residue differences or residue difference sets as compared to SEQ ID NO: 5636, selected from: 65M, 65M/70Q/155K/209E/228L, 65M/128K/209E/371P/373T, 65M/151K, 65M/155K/209E, 65M/155K/209E/352K/353N, 65M/159R, 65M/209E/219T/352K/353N, 65M/209E/352K/353N/371P, 65M/228L/352K/353N/373T, 65M/228L/371P/373T, 65M/352K/353N/371P, 128K/159R/209E/352K/353N, 128K/209E, 128K/209E/219T, 128K/209E/219T/352K/353N/371P, 128K/209E/228L/371P, 128K/209E/371P, 128K/209E/371P/373T, 128K/209E/373T, 128K/338D/352K/353N/373T, 151K/209E, 151K/209E/371P, 151K/209E/373T, 151K/228L/352K/353N/373T, 151K/228L/373T, 151K/352K/353N, 151K/352K/353N/371P/373T, 155K, 155K/209E, 155K/228L/352K/353N, 159R/209E/352K/353N, 208M/209E, 209E, 209E/219T/352K/353N/371P, 209E/219T/371P, 209E/228L, 209E/352K/353N/371P, 209E/371P, 209E/371P/373T, 209E/373T, 219T/228L, 219T/352K/353N/371P/373T, 219T/371P/373T, 228L, 228L/371P, 228L/371P/373T, 228L/373T, 352K/353N, 352K/353N/371P, 371P, 371P/373T, and 373T. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5636 and one or more residue differences or residue difference sets as compared to SEQ ID NO: 5636, selected from: L65M, L65M/E70Q/E155K/T209E/I228L, L65M/A128K/T209E/S371P/D373T, L65M/L151K, L65M/E155K/T209E, L65M/E155K/T209E/R352K/D353N, L65M/A159R, L65M/T209E/P219T/R352K/D353N, L65M/T209E/R352K/D353N/S371P, L65M/I228L/R352K/D353N/D373T, L65M/I228L/S371P/D373T, L65M/R352K/D353N/S371P, A128K/A159R/T209E/R352K/D353N, A128K/T209E, A128K/T209E/P219T, A128K/T209E/P219T/R352K/D353N/S371P, A128K/T209E/I228L/S371P, A128K/T209E/S371P, A128K/T209E/S371P/D373T, A128K/T209E/D373T, A128K/G338D/R352K/D353N/D373T, L151K/T209E, L151K/T209E/S371P, L151K/T209E/D373T, L151K/I228L/R352K/D353N/D373T, L151K/I228L/D373T, L151K/R352K/D353N, L151K/R352K/D353N/S371P/D373T, E155K, E155K/T209E, E155K/I228L/R352K/D353N, A159R/T209E/R352K/D353N, V208M/T209E, T209E, T209E/P219T/R352K/D353N/S371P, T209E/P219T/S371P, T209E/I228L, T209E/R352K/D353N/S371P, T209E/S371P, T209E/S371P/D373T, T209E/D373T, P219T/I228L, P219T/R352K/D353N/S371P/D373T, P219T/S371P/D373T, I228L, I228L/S371P, I228L/S371P/D373T, I228L/D373T, R352K/D353N, R352K/D353N/S371P, S371P, S371P/D373T, and D373T.

In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5636 and one or more residue differences or residue difference sets as compared to SEQ ID NO: 5636, selected from: 55/65/151, 65, 65/70/155/209/228, 65/70/228/373, 65/128, 65/128/155/209/371, 65/128/159/209/371/373, 65/128/209/371, 65/128/209/371/373, 65/128/219/373, 65/128/373, 65/151, 65/155/209, 65/155/209/352/353, 65/159, 65/209/219/352/353, 65/209/352/353/371, 65/219/371, 65/228/352/353/373, 65/228/371, 65/228/371/373, 65/352/353, 65/352/353/371, 65/373, 70/155/352/353, 128, 128/155/209, 128/159, 128/159/209/352/353, 128/209, 128/209/219, 128/209/219/352/353/371, 128/209/228/371, 128/209/371, 128/209/371/373, 128/209/373, 128/219/352/353, 128/219/371/373, 128/228/352/353, 128/228/371, 128/228/373, 128/352/353, 128/352/353/373, 128/371, 128/371/373, 128/373, 151, 151/155, 151/155/209, 151/155/209/219/228/371/373, 151/155/209/373, 151/155/219/352/353/371, 151/155/352/353, 151/155/352/353/371/373, 151/155/352/353/373, 151/209, 151/209/371, 151/209/371/373, 151/209/373, 151/219, 151/219/371, 151/228/352/353/373, 151/228/373, 151/352/353, 151/352/353/371/373, 151/371, 151/373, 155, 155/209, 155/219, 155/228/352/353, 155/228/371, 155/228/371/373, 155/352/353/373, 155/371, 155/371/373, 155/373, 159/209/352/353, 209, 209/219/352/353/371, 209/219/371, 209/228, 209/352/353/371, 209/371, 209/371/373, 209/373, 219, 219/228, 219/352/353/371/373, 219/352/353/373, 219/371, 219/371/373, 228/352/353, 228/371, 228/371/373, 228/373, 352/353, 352/353/371, 352/353/373, 371, 371/373, and 373. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5636 and one or more residue differences or residue difference sets as compared to SEQ ID NO: 5636, selected from: 55T/65M/151K, 65M, 65M/70Q/155K/209E/228L, 65M/70Q/228L/373T, 65M/128K, 65M/128K/155K/209E/371P, 65M/128K/159Q/209E/371P/373T, 65M/128K/209E/371P, 65M/128K/209E/371P/373T, 65M/128K/219T/373T, 65M/128K/373T, 65M/151K, 65M/155K/209E, 65M/155K/209E/352K/353N, 65M/159R, 65M/209E/219T/352K/353N, 65M/209E/352K/353N/371P, 65M/219T/371P, 65M/228L/352K/353N/373T, 65M/228L/371P, 65M/228L/371P/373T, 65M/352K/353N, 65M/352K/353N/371P, 65M/373T, 70Q/155K/352K/353N, 128K, 128K/155K/209E, 128K/159Q, 128K/159R, 128K/159R/209E/352K/353N, 128K/209E, 128K/209E/219T, 128K/209E/219T/352K/353N/371P, 128K/209E/228L/371P, 128K/209E/371P, 128K/209E/371P/373T, 128K/209E/373T, 128K/219T/352K/353N, 128K/219T/371P/373T, 128K/228L/352K/353N, 128K/228L/371P, 128K/228L/373T, 128K/352K/353N, 128K/352K/353N/373T, 128K/371P, 128K/371P/373T, 128K/373T, 151K, 151K/155K, 151K/155K/209E, 151K/155K/209E/219T/228L/371P/373T, 151K/155K/209E/373T, 151K/155K/219T/352K/353N/371P, 151K/155K/352K/353N, 151K/155K/352K/353N/371P/373T, 151K/155K/352K/353N/373T, 151K/209E, 151K/209E/371P, 151K/209E/371P/373T, 151K/209E/373T, 151K/219T, 151K/219T/371P, 151K/228L/352K/353N/373T, 151K/228L/373T, 151K/352K/353N, 151K/352K/353N/371P/373T, 151K/371P, 151K/373T, 155K, 155K/209E, 155K/219T, 155K/228L/352K/353N, 155K/228L/371P, 155K/228L/371P/373T, 155K/352K/353N/373T, 155K/371P, 155K/371P/373T, 155K/373T, 159R/209E/352K/353N, 209E, 209E/219T/352K/353N/371P, 209E/219T/371P, 209E/228L, 209E/352K/353N/371P, 209E/371P, 209E/371P/373T, 209E/373T, 219T, 219T/228L, 219T/352K/353N/371P/373T, 219T/352K/353N/373T, 219T/371P, 219T/371P/373T, 228L/352K/353N, 228L/371P, 228L/371P/373T, 228L/373T, 352K/353N, 352K/353N/371P, 352K/353N/373T, 371P, 371P/373T, and 373T. In some embodiments, the engineered TdT polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NO: 5636 and one or more residue differences or residue difference sets as compared to SEQ ID NO: 5636, selected from: M55T/L65M/L151K, L65M, L65M/E70Q/E155K/T209E/I228L, L65M/E70Q/I228L/D373T, L65M/A128K, L65M/A128K/E155K/T209E/S371P, L65M/A128K/A159Q/T209E/S371P/D373T, L65M/A128K/T209E/S371P, L65M/A128K/T209E/S371P/D373T, L65M/A128K/P219T/D373T, L65M/A128K/D373T, L65M/L151K, L65M/E155K/T209E, L65M/E155K/T209E/R352K/D353N, L65M/A159R, L65M/T209E/P219T/R352K/D353N, L65M/T209E/R352K/D353N/S371P, L65M/P219T/S371P, L65M/I228L/R352K/D353N/D373T, L65M/I228L/S371P, L65M/I228L/S371P/D373T, L65M/R352K/D353N, L65M/R352K/D353N/S371P, L65M/D373T, E70Q/E155K/R352K/D353N, A128K, A128K/E155K/T209E, A128K/A159Q, A128K/A159R, A128K/A159R/T209E/R352K/D353N, A128K/T209E, A128K/T209E/P219T, A128K/T209E/P219T/R352K/D353N/S371P, A128K/T209E/I228L/S371P, A128K/T209E/S371P, A128K/T209E/S371P/D373T, A128K/T209E/D373T, A128K/P219T/R352K/D353N, A128K/P219T/S371P/D373T, A128K/I228L/R352K/D353N, A128K/I228L/S371P, A128K/I228L/D373T, A128K/R352K/D353N, A128K/R352K/D353N/D373T, A128K/S371P, A128K/S371P/D373T, A128K/D373T, L151K, L151K/E155K, L151K/E155K/T209E, L151K/E155K/T209E/P219T/I228L/S371P/D373T, L151K/E155K/T209E/D373T, L151K/E155K/P219T/R352K/D353N/S371P, L151K/E155K/R352K/D353N, L151K/E155K/R352K/D353N/S371P/D373T, L151K/E155K/R352K/D353N/D373T, L151K/T209E, L151K/T209E/S371P, L151K/T209E/S371P/D373T, L151K/T209E/D373T, L151K/P219T, L151K/P219T/S371P, L151K/I228L/R352K/D353N/D373T, L151K/I228L/D373T, L151K/R352K/D353N, L151K/R352K/D353N/S371P/D373T, L151K/S371P, L151K/D373T, E155K, E155K/T209E, E155K/P219T, E155K/I228L/R352K/D353N, E155K/I228L/S371P, E155K/I228L/S371P/D373T, E155K/R352K/D353N/D373T, E155K/S371P, E155K/S371P/D373T, E155K/D373T, A159R/T209E/R352K/D353N, T209E, T209E/P219T/R352K/D353N/S371P, T209E/P219T/S371P, T209E/I228L, T209E/R352K/D353N/S371P, T209E/S371P, T209E/S371P/D373T, T209E/D373T, P219T, P219T/I228L, P219T/R352K/D353N/S371P/D373T, P219T/R352K/D353N/D373T, P219T/S371P, P219T/S371P/D373T, I228L/R352K/D353N, I228L/S371P, I228L/S371P/D373T, I228L/D373T, R352K/D353N, R352K/D353N/S371P, R352K/D353N/D373T, S371P, S371P/D373T, and D373T.

In some embodiments, the engineered TdT polypeptide comprises an amino acid sequence having at least 60%, 70%, 60%, 70%, 80%, 85%, 86%, 87%, 88%, 89%, 90%, 91%, 92%, 93%, 94%, 95%, 96%, 97%, 98%, 99% or more sequence identity to a reference sequence selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636 and one or more residue differences or residue difference sets as compared to a reference sequence selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636, at positions selected from: 9, 10, 11, 12, 14, 15, 16, 17, 18, 19, 20, 21, 22, 23, 24, 26, 27, 28, 29, 30, 32, 34, 36, 38, 40, 42, 44, 47, 48, 49, 50, 51, 52, 53, 54, 55, 56, 57, 58, 59, 60, 61, 62, 63, 64, 65, 66, 67, 68, 69, 70, 71, 72, 73, 74, 75, 77, 78, 79, 80, 82, 84, 85, 86, 87, 89, 91, 92, 93, 94, 96, 97, 98, 99, 100, 101, 102, 103, 104, 105, 106, 107, 108, 109, 110, 111, 112, 113, 115, 116, 117, 118, 119, 120, 122, 123, 124, 125, 127, 131, 133, 134, 135, 136, 140, 141, 143, 144, 145, 147, 148, 153, 154, 155, 156, 157, 158, 159, 160, 161, 162, 163, 164, 165, 166, 167, 168, 170, 173, 174, 175, 176, 177, 180, 181, 182, 184, 185, 186, 187, 189, 190, 192, 193, 194, 196, 197, 198, 200, 201, 202, 203, 204, 205, 206, 207, 209, 210, 211, 217, 219, 220, 224, 226, 228, 229, 230, 231, 232, 233, 234, 235, 236, 237, 238, 239, 241, 242, 243, 244, 245, 246, 248, 249, 250, 252, 253, 256, 257, 258, 259, 260, 261, 262, 263, 264, 265, 266, 267, 268, 269, 270, 271, 272, 273, 274, 275, 276, 277, 278, 279, 280, 282, 284, 286, 287, 288, 289, 290, 291, 292, 293, 294, 295, 296, 297, 298, 299, 300, 301, 302, 303, 304, 305, 306, 307, 308, 309, 310, 311, 315, 319, 321, 322, 323, 324, 325, 326, 327, 328, 329, 330, 332, 338, 339, 340, 341, 342, 344, 345, 346, 347, 349, 350, 351, 352, 353, 355, 358, 360, 361, 364, 365, 366, 367, 368, 369, 370, 371, 372, 373, 374, 376, 377, 378, 380, 383, 384, 386, 387, 388, and 390.

In some embodiments, the engineered TdT polypeptide comprises an amino acid sequence having at least 60%, 70%, 60%, 70%, 80%, 85%, 86%, 87%, 88%, 89%, 90%, 91%, 92%, 93%, 94%, 95%, 96%, 97%, 98%, 99% or more sequence identity to a reference sequence selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636 and one or more residue differences or residue difference sets as compared to a reference sequence selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636, at positions selected from: 8, 9, 9/11, 9/14/190/197/364, 9/14/58, 9/14/58/182/190/197/298, 9/28/156/158/173/190/193/303/364, 9/28/156/158/290/364, 9/28/190/193/303/364, 9/28/290/303/364, 9/58/197, 9/156/158/193/290/303/364, 9/156/364, 9/290/364, 9/298, 9/302, 9/364, 10, 10/14/197/364, 11, 12, 14, 14/15/200/230, 14/15/77/200/226/230, 14/15/77/78, 14/15/77/78/200/201/226/230/290, 14/15/77/78/200/203/230/290, 14/15/77/78/203/226/230/290, 14/15/78, 14/15/78/226/230, 14/28/224/296/298, 14/28/58/162/190/193/224, 14/28/58/224, 14/28/58/84/173/297, 14/58/147/162/190/193/224/296/303, 14/58/158/224, 14/58/162, 14/58/182/197/298/364, 14/58/84/147/162/224/296/297/298/299, 14/58/84/147/162/224/296/297/299, 14/58/84/224/298, 14/77/201/230, 14/77/78/200/226/230/257, 14/77/78/226/230/257, 14/78/200/201/226/290, 14/78/200/201/339, 14/78/200/226/230/339, 14/78/200/226/290/339, 14/78/200/230/339, 14/84/147/193/197/224/296, 14/84/162/224/297/299, 14/84/224/296/299, 14/147, 14/147/158/162/224, 14/147/173, 14/147/224, 14/158/162/197/224/296/298/299, 14/162/224/298/299, 14/173/193/197/296/297/298/299, 14/190/197/298, 14/193/197/224/297/298/299/300, 14/197/298/364, 14/200/203/226/230, 14/200/203/226/230/257/339, 14/200/203/230/339, 14/201/203/226, 14/224/296/298, 14/224/296/303, 14/298/364, 15, 15/77, 15/77/200/201/203/226/230/290/339, 15/77/200/230, 15/77/200/230/290/339, 15/77/201/226/230/339, 15/77/226/230/290/339, 15/77/78, 15/77/78/200/201/203/226/230, 15/78/201, 15/78/201/203/230, 15/78/201/230/290, 15/78/203/226/230, 15/200, 15/201/203/226/230/257/339, 15/226/230/339, 15/230, 16, 17, 18, 18/28/147/303, 19, 20, 20/21, 20/21/103/233, 20/21/111, 20/21/111/157/315, 20/21/111/160/200, 20/21/111/200/238, 20/21/111/246, 20/21/180/297, 20/21/233, 20/21/315, 20/21/52/67/68/87/111/157/160/173/180/200/235/246/315, 20/21/55/67/68/87/111/157/160/180/181/200/235/246/256/315/350, 20/21/55/67/68/87/111/157/160/180/200/246/256/315, 20/21/60/72/160/180/200/246/259/338/358, 20/21/67, 20/21/67/160, 20/21/67/68/87/111/157/160/180/200/235/246/315, 20/21/67/68/87/111/157/160/180/200/246/315, 20/21/67/87, 20/21/67/87/111, 20/21/67/87/111/200, 20/21/67/87/111/315, 20/21/67/87/157/180, 20/21/67/87/246/315, 20/21/68/103/200/238/297, 20/21/68/111/235, 20/21/68/160, 20/21/68/160/180/200/246, 20/21/68/160/246, 20/21/68/180, 20/21/68/180/235, 20/21/68/200/235/297, 20/21/68/233/246/297, 20/21/87/111/246/315, 20/21/87/157/200, 20/21/87/180/246/315, 20/21/87/315, 20/67/87/111/180, 20/67/87/157/160/180/315, 20/68/103/160/200, 20/68/103/180/200, 20/68/111/157/160, 20/68/160, 20/68/160/180, 20/68/160/180/233/235/246, 20/68/160/200/246, 20/68/160/235/297, 20/68/160/246, 20/68/200/238/246, 20/68/235/297, 20/87/111/180, 20/87/157/160, 20/100, 20/100/104/111/242, 20/100/104/120/197/367, 20/100/104/197/203/242/292, 20/100/104/203/350/353, 20/100/111, 20/100/120/197/232/235/315/366/367, 20/100/197/292/315, 20/100/203, 20/100/232/292/366/367, 20/100/235/315/367, 20/103/160/180/200/235, 20/103/233, 20/104/111/120/203, 20/111, 20/111/180/235/246/297, 20/120/197/292, 20/120/235, 20/160/315, 20/200, 20/292, 21, 21/67/180/315, 21/67/200, 21/67/87/111/200, 21/67/87/157/246, 21/68, 21/68/103/111, 21/68/111/200, 21/68/160/180/200/205/297, 21/68/160/180/200/297, 21/68/160/238, 21/68/160/238/246, 21/68/180, 21/68/180/235, 21/68/180/246, 21/68/200, 21/68/235, 21/87/157/160, 21/87/160/200/315, 21/87/160/315, 21/87/200, 21/87/246/315, 21/103/233, 21/111, 21/157/160, 21/160/315, 21/200/315, 21/233/297, 21/246, 22, 23, 23/28/156/158/190/193/290/364, 23/186/256/309, 24, 26, 26/60/200, 26/60/200/203/229/234/267, 26/60/200/203/229/267, 26/60/200/203/229/267/290, 26/60/200/203/234/267, 26/60/200/203/292, 26/60/200/234/290, 26/60/203/229/234/290, 26/60/229/267, 26/60/29026/200, 26/200/203, 26/200/203/229, 26/200/290, 26/203/234/290/292, 26/229/234/360, 27, 28, 29, 29/77/104/234/271, 29/77/104/234/271/279/380, 29/77/182/207/271, 29/77/207/234/279/380, 29/77/234/271/279/368, 29/77/271, 29/98/143/266, 29/98/185/197/266, 29/98/185/266/296/299, 29/104/234/271/279/380, 29/143, 29/143/162, 29/143/170/193/197/266, 29/143/185/193/266, 29/158/266, 29/170/185/193/266/299, 29/182/207/380, 29/182/234/271/380, 29/182/271/279/380, 29/185/296, 29/193/197/296/297, 29/234/279/380, 29/271/279, 29/271/279/368/380, 30, 32, 32/72/339, 32/72/339/360, 32/78/106/200/226/272/373, 32/78/106/200/226/373, 32/78/106/226, 32/78/200/226, 32/78/200/226/235/272, 32/78/200/226/235/321/373, 32/78/226, 32/78/226/321, 32/78/226/373, 32/103, 32/103/106/111/322/324, 32/103/106/207/210/235/321/368, 32/103/207/210/344/349, 32/103/207/228/232/373, 32/103/207/321/344, 32/103/210/273/321/373, 32/103/273, 32/103/321/344, 32/106, 32/106/200/226, 32/106/200/226/235/373, 32/106/207/210/232, 32/106/210, 32/106/210/373, 32/106/235/321, 32/106/235/368, 32/106/273/321/373, 32/106/280, 32/111/235, 32/111/235/271/272/339, 32/111/235/339, 32/111/235/339/386, 32/111/235/386, 32/140/141/261/360, 32/140/339, 32/140/360, 32/141/180/244, 32/161/193/237/360, 32/162, 32/162/193, 32/162/193/267, 32/162/237/265/266, 32/162/302, 32/180/261/339, 32/200/226, 32/200/226/321/373, 32/207/210/273, 32/207/210/279, 32/207/210/368/373, 32/207/235, 32/207/273/279/321, 32/207/279, 32/207/344, 32/210/232/235/368, 32/210/232/273/321, 32/210/232/273/368/373, 32/210/273, 32/226, 32/235, 32/235/271/339, 32/235/272, 32/235/272/339, 32/235/272/386, 32/235/273, 32/235/339/386, 32/235/386, 32/244/261, 32/271/339, 32/272, 32/273/

279/344/349, 32/273/344/373, 32/279, 32/279/321, 32/302, 32/321/324/360, 32/322/324/383/386, 32/324, 32/339, 34, 34/48/133/158/182/230/233/271/345, 34/48/147, 34/48/147/158/182/220/233/307, 34/48/147/182/230/233/249/307, 34/48/147/271, 34/48/182/233/249, 34/48/339, 34/48/78/133/147/182, 34/48/78/147/158, 34/48/78/147/182/220/233/249/307/315/339, 34/48/78/158/182/220/249/307, 34/48/78/158/182/233/315/345, 34/48/78/182/220/230/315, 34/48/78/182/220/233, 34/78, 34/78/147/182/220/249, 34/78/147/182/233/249/315, 34/78/147/182/233/271/339, 34/78/158, 34/78/158/182/315/345, 34/78/158/249, 34/78/182/233/307, 34/78/204/220/339, 34/78/220/271, 34/78/220/307/339, 34/78/315, 34/78/84/147/158/182/220, 34/78/84/158/230, 34/133/147/158/230/233/249, 34/147, 34/147/155/233/339, 34/147/158, 34/147/158/182/233, 34/147/158/182/249/271, 34/147/182, 34/147/182/220, 34/147/182/220/230/249/315/339, 34/147/182/220/230/339, 34/147/182/220/271/315, 34/147/182/233/271/339, 34/147/182/249/307/315/339, 34/147/182/315, 34/147/182/345, 34/147/220/271, 34/147/230/273/315/345, 34/147/233, 34/147/249, 34/147/315/339, 34/158/182/315/339/345, 34/158/220, 34/158/307, 34/182, 34/182/230/315, 34/182/307/339, 34/182/345, 34/220, 34/220/307, 34/220/307/345, 34/220/315/339, 34/220/339, 34/233, 34/271/339, 34/315/345, 34/339, 36, 38, 40, 42, 44, 44/193, 47, 48, 48/53/237/239, 48/78/147/158/182/220/230/307, 48/78/147/158/182/230/249/271/315, 48/78/147/158/233/249, 48/78/147/182/220/233/249/339/345, 48/78/147/182/220/315, 48/78/147/182/230/233/249, 48/78/158/182/220/233/249, 48/78/158/230/339, 48/78/233/315/339, 48/147/158/182/220/230/249/271/307/315/339, 48/147/158/182/220/249/307/339, 48/147/158/182/220/315, 48/147/158/182/230/233, 48/147/158/182/233/345, 48/147/158/233, 48/147/158/307/345, 48/147/233, 48/147/233/345, 48/147/271/307/339, 48/158/182/230/233/249, 48/182, 48/182/307/315, 48/256/261, 48/339, 49, 50, 51, 52, 52/55/106/256, 52/55/181/235/256, 52/55/181/256, 52/99/181/235, 52/106/181/235/256, 52/106/235/256, 52/106/256, 52/173/235, 52/180, 52/180/200/235/315/349, 52/180/200/349, 52/180/349, 52/200, 52/200/315, 52/200/349, 52/200/349/350, 52/235, 52/235/256, 52/315, 52/315/349, 52/349, 52/349/350, 53, 53/73/75/237/239, 53/157/278/327/331, 53/162/327/331/368, 53/163/201/325/329, 53/200/201/325/329, 53/201, 53/201/275/280, 53/201/371, 53/219/358, 53/237, 54, 55, 55/58, 55/58/256, 55/58/256/350/373, 55/58/256/355, 55/58/350/351, 55/58/69/350/351, 55/58/99/256/351/373, 55/58/99/256/355, 55/58/99/351, 55/67, 55/67/106/111/157, 55/67/106/315, 55/67/111, 55/67/111/315, 55/67/315, 55/67/87, 55/67/87/106/111/315, 55/67/87/157/315, 55/80/174/268/355/366, 55/80/268/315/366, 55/80/268/346, 55/87, 55/87/106, 55/87/106/111/315, 55/87/106/315, 55/87/157, 55/87/157/207, 55/99/103, 55/99/181/256, 55/99/219/358/373, 55/99/256/350, 55/103/181, 55/103/219, 55/103/338, 55/106/111, 55/106/157, 55/111, 55/111/156/268/315/324/327/366/373, 55/111/268/346/355, 55/111/268/355/366, 55/111/315, 55/111/315/355/373, 55/157, 55/181/219, 55/181/235/256/350, 55/181/246, 55/181/358, 55/219/246/358, 55/219/256/338, 55/256, 55/256/259, 55/268, 55/268/315/346, 55/268/324/366, 55/268/346/355, 55/315, 56, 56/75/154/156/192/239/280/282, 56/75/192/239, 56/192/282/350, 57, 57/367, 58, 58/69/256/373, 58/72/211/315, 58/72/220/224, 58/84/211/220/224, 58/99, 58/99/351/355, 58/99/355, 58/147/162/197/224/296/297/298/299, 58/147/162/296/298, 58/162/224/296/298, 58/186/270, 58/197, 58/197/364, 58/224, 58/224/299, 58/256, 58/256/350/355, 58/350/355, 58/364, 59, 59/62/63/68, 59/62/63/68/103/234, 59/62/63/68/147, 60, 60/62/68/91/111/234/289, 60/106/111/235/360, 60/200/203/290, 60/200/229/234, 60/200/234, 60/200/234/267/290/292, 60/200/234/290, 60/203, 60/259, 60/278, 60/280/360, 61, 62, 62/63/68, 62/63/68/91/109/210, 62/63/68/91/147/205/210/234, 62/66/100/101/104/203/235/338, 62/66/69/143/338/353, 62/68/103, 62/68/111, 62/68/91/111/289, 62/69/100/235/268/346, 62/69/353, 62/69/80/101/104/143/235/338, 62/111/235/315/355, 62/111/235/324/346, 62/203/211/235/338/350, 62/235/268/327/346/350/353/355, 62/235/346/350/355, 62/315/327/353, 62/323/346/353/355, 63, 64, 65, 65/70/155/209/228, 65/128/209/371/373, 65/140, 65/140/192/193, 65/140/192/193/302, 65/151, 65/155/209, 65/155/209/352/353, 65/159, 65/184/187, 65/193, 65/209/219/352/353, 65/209/352/353/371, 65/220/339, 65/228/352/353/373, 65/228/371/373, 65/259, 65/352/353/371, 66, 66/69/143/235/338, 66/100/235/315/327/353/355, 66/111/346/353/355, 66/220/224, 66/235/268/346, 66/235/346, 66/235/373, 67, 67/87, 67/87/106/157, 67/87/111/157/160/315, 67/87/111/157/315, 67/87/157, 67/87/315, 67/106, 67/106/111, 67/106/111/315, 67/106/157, 67/111, 67/111/315, 67/157, 67/157/160/180, 67/157/160/315, 67/157/315, 67/160, 67/180/200, 67/180/200/315, 67/315, 68, 68/87, 68/103/160/235, 68/103/200/235/246/297, 68/106/200, 68/106/321/322, 68/111/200/238, 68/111/233/236/297, 68/118, 68/157/160/200/315, 68/160/233/246, 68/200, 68/200/235/297, 68/200/270/321, 68/270/321/322, 68/344, 68/344/383, 69, 69/80/203/211/278/338, 69/100, 69/100/111/298/353/355, 69/100/235, 69/100/353/366, 69/111/235, 69/111/235/300/353/355, 69/111/235/315, 69/220, 69/235/315, 69/235/353, 69/268, 69/268/324/327/353/355, 69/268/346, 69/268/346/353, 69/315/353, 69/324/327/346, 69/324/346/350, 69/324/353, 69/339, 69/353/355, 70, 70/71, 70/71/353, 70/72, 70/72/140/244/261/339, 70/72/141/244, 70/72/180/360, 70/134/353, 70/140/141/339, 70/261/339/360, 70/353, 70/360, 71, 71/77/133/353, 71/77/353, 71/353, 72, 72/74/200/272/339/347, 72/84/220/224/315, 72/84/86/224, 72/86/220, 72/180/244/339, 72/220/224, 72/220/315, 72/256/360, 72/360, 73, 74, 74/106/270/344, 74/200/339, 74/272, 75, 75/207/373/378, 75/233/344, 75/233/366, 75/237/350, 77, 77/78/200/226/339, 77/78/201/226/257/339, 77/78/203, 77/78/203/230/339, 77/133/353, 77/134/353, 77/182/279/380, 77/182/368, 77/200/201, 77/200/201/226/230/339, 77/200/203/230/257/339, 77/200/230, 77/234/271/279/380, 77/353, 78, 78/106, 78/106/226/321/373, 78/106/235/321/373, 78/127, 78/133/147/158/182/220/271/339, 78/135/182/233/249/315/345, 78/147/158/182, 78/147/158/182/230/249, 78/147/158/182/233/271/307/345, 78/147/158/182/339/345, 78/147/158/220/230/233/249/271/307/315/345, 78/147/158/249/307/315, 78/147/182/230/233/249, 78/147/182/249/307, 78/147/182/339/345, 78/147/230/307, 78/147/233, 78/147/249/271/339, 78/158/182, 78/158/182/233/271/315, 78/158/182/307/315/345, 78/182/220/339, 78/182/271/315/339, 78/200/226/321/373, 78/200/230, 78/203/230/290, 78/226/230, 78/226/290, 78/226/321, 78/233, 78/339, 79, 80, 80/111/268/324/327/346/366/373, 80/111/355/366, 80/143/203/211/338, 80/268/315/346/355, 80/268/327/346/366, 80/268/346, 80/315/346/364/373, 80/346/366, 82, 82/154/296, 82/184/220/386, 84, 84/92/173, 84/147, 84/147/197/296/297, 84/147/297/298/303, 84/156/173/204, 84/173/204/303, 84/173/224, 84/220/315, 84/224/297/298/299, 85, 86, 87, 87/106, 87/106/111/315, 87/111, 87/111/157/315, 87/111/200, 87/111/200/246, 87/157, 87/157/180/200, 87/157/315, 87/315, 89, 91, 91/109/111, 91/109/147/205/210/234, 92, 92/173/204/290/303, 93, 94, 96, 97, 98, 98/143/158/170/185/296/297, 98/143/162/266, 98/143/185/266, 98/162/193, 98/170/193/197, 98/185, 98/185/193/197/266/297, 99, 99/103/219, 99/235, 99/256/351/355, 100, 100/101/211/278/338/350/353, 100/111, 100/111/353, 100/120/197/242, 100/235/268/

315/346, 100/235/268/346/355, 100/235/268/366/373, 100/235/346/350/353, 100/268/346, 100/268/366, 101, 102, 103, 103/106/207/321, 103/106/210, 103/106/360, 103/111/235/280/360, 103/111/235/321/324, 103/160/180, 103/160/297, 103/207/210/235/321, 103/210/232/235, 103/219/256, 103/219/338/358, 103/232/273, 103/233, 103/256, 103/259, 103/324, 104, 104/106, 104/106/111/200/201/235/268/368, 104/106/111/200/201/268, 104/106/111/201/235/368, 104/106/200/201/268, 104/120/232/353, 104/182, 104/200/207/237/344/373/387, 104/207/344/387, 105, 106, 106/111, 106/111/157, 106/111/200/201, 106/111/200/201/268/368, 106/111/200/235/368, 106/111/201, 106/111/201/368, 106/111/322/324/386, 106/111/322/383/386, 106/173/200/235/315, 106/173/388, 106/182/203/226/235/342/346, 106/200/201, 106/200/201/209/368, 106/200/201/235, 106/200/201/368, 106/200/226/373, 106/200/321/322/383, 106/201/235, 106/201/268, 106/207/210/232/235/321/368/373, 106/207/235/321/368, 106/226/235/373, 106/235, 106/235/273/373, 106/235/383/386, 106/270/344, 106/273, 106/315, 106/324, 107, 108, 109, 109/111/205/210/234/289, 110, 111, 111/157/180/200/315, 111/160/233/235/297, 111/173, 111/173/235/315, 111/197/242, 111/200/201/268, 111/200/368, 111/226, 111/226/321/344/346/369/387, 111/235, 111/235/268/327/346, 111/235/268/346, 111/235/271/339, 111/235/272/339/386, 111/235/280, 111/235/339, 111/235/346/350, 111/268, 111/272/339/386, 111/322/360, 111/327, 111/346, 112, 113, 113/355, 115, 116, 117, 118, 119, 120, 122, 123, 124, 125, 128, 128/159/209/352/353, 128/209, 128/209/2, 128/209/219, 128/209/219/352/353/371, 128/296, 131, 133, 133/135/307/315, 133/220/233/271, 133/307, 134, 134/353, 135, 136, 140, 140/141/256/261/339, 140/180/244/261/339/360, 140/192/193/302, 140/193/302, 141, 141/244/261/360, 141/244/360, 141/256/339/360, 141/261, 141/261/339, 141/360, 143, 143/158/197/266, 143/266/296/297, 144, 144/220, 145, 147, 147/158/162/190/224/296/297/299/303, 147/158/182/220/233, 147/158/182/230/233/249/271/339, 147/158/182/233/249, 147/158/182/233/271/307/339, 147/158/182/233/307/339, 147/158/182/233/315/345, 147/158/182/271/315, 147/158/182/315, 147/158/220/230/233/249/345, 147/158/220/249/315, 147/158/233/249, 147/182/220/233/345, 147/182/230/307/315/339, 147/182/233, 147/182/233/249, 147/182/249/271/307, 147/182/345, 147/210/234, 147/220, 147/224, 147/224/297/298, 147/232/233/271/315/339, 147/233/345, 147/249, 147/290/303/307, 147/339, 148, 149, 150/244/261/360, 151, 153, 154, 154/156/282/350, 154/166, 154/166/210/296, 154/166/346/347, 154/166/347, 154/167/210/347/349, 154/184, 154/187/220/350/386, 154/293, 154/296/347, 154/339, 154/347, 154/350, 154/386, 155, 155/220/325/339, 156, 156/158/190/193/364, 156/166/167, 156/210/339, 157, 157/160, 157/162, 157/162/241/242/260, 157/162/241/242/327/331, 157/162/241/278/331/368, 157/162/241/331, 157/162/242/260/331, 157/162/331, 157/315, 157/327/331, 157/368, 158, 158/182/220/230/249/307/339, 158/193/290/303, 158/233, 158/307, 158/315, 158/315/339, 159, 160, 160/296, 161, 161/162, 161/237, 162, 162/193/232/267/302/360, 162/224, 162/237/265/266/267/302, 162/241/278/327/331, 162/241/331, 162/242/368, 162/265, 162/267/360, 162/367/371, 163, 163/201, 164, 164/275/280, 165, 166, 166/210, 166/296, 166/346/347, 167, 167/210/346/349, 168, 169/390, 170, 170/193/197, 173, 173/204, 173/204/303, 173/297, 174, 175, 176, 177, 180, 180/339, 181, 182, 182/186/256/360, 182/197, 182/201/203/226/234/235/346, 182/201/203/226/234/342/346, 182/201/203/226/235, 182/201/203/226/235/346, 182/201/203/226/342/346, 182/201/203/268/346, 182/201/226/234/342/346, 182/201/226/235/346, 182/201/226/268/346, 182/201/342, 182/203/226, 182/207/279/368, 182/220/345, 182/226/234/268/342/346, 182/226/234/346, 182/226/235, 182/226/235/268/346, 182/226/235/342, 182/226/235/346, 182/226/268/342/346, 182/226/342, 182/226/346, 182/230, 182/230/233, 182/234/380, 182/256, 182/279/368/380, 182/298/364, 182/342/346, 182/345, 184, 184/187, 184/188/200/203/211/242, 184/188/200/203/242/297, 184/188/200/203/290/297/368, 184/188/203/290/297, 184/188/211/242/290/368, 184/189, 184/189/206/297/368, 184/189/297, 184/200, 184/206/242/290/297, 184/211, 184/242, 184/242/297/368, 184/290/297, 184/290/368, 184/293, 185, 186, 186/256, 186/256/270, 187, 187/220/350, 187/293, 188, 188/211, 188/211/242/290/297/368, 189, 189/200, 190, 190/193/197, 191, 192, 192/193, 192/193/211/242/297/368, 192/193/290/297/368, 193, 193/194, 193/197/296/303, 193/267, 193/290, 194, 194/242, 194/242/290, 195, 196, 197, 197/298, 198, 198/289, 199, 200, 200/202/203, 200/203, 200/203/226/230/339, 200/203/229/234, 200/203/290, 200/203/290/368, 200/206, 200/226, 200/226/321/373, 200/226/373, 200/230/257, 200/234/290, 200/235/368, 200/270, 200/270/275/339, 200/270/322/383, 200/271, 200/290/292/360, 200/344, 200/368, 201, 201/202, 201/202/272/360, 201/203, 201/203/226/234, 201/203/226/234/342/346, 201/203/226/234/346, 201/203/226/268/342, 201/203/226/346, 201/203/268/342, 201/203/268/346, 201/226/234/342/346, 201/226/234/346, 201/226/235/342, 201/226/268/346, 201/226/346, 201/230/257, 201/230/290, 201/235/268/342/346, 201/368, 201/371, 202, 202/233, 202/235/360/367/371, 203, 203/206/368, 203/226, 203/226/230, 203/226/230/257, 203/226/234/235, 203/226/234/235/346, 203/226/235/268/346, 203/226/235/342, 203/226/235/346, 203/226/342/346, 203/226/346, 203/229, 203/242/290/297/368, 203/297, 204, 204/264/340, 205, 206, 206/290, 206/297, 207, 207/210/273/279/344, 207/210/273/279/344/349/373, 207/210/273/321/344/349, 207/233/237/344/387, 207/235, 207/235/327/360/371, 207/235/368, 207/271/368/380, 207/273, 207/279/349, 207/368/373, 207/373, 207/380, 207/387, 209, 209/211, 210, 210/211, 210/211/242, 210/273/279, 210/273/279/349, 210/279, 210/339, 211, 211/368, 217, 219, 219/300, 219/358, 220, 220/224/315, 220/249, 220/293, 220/307/339, 220/315, 220/339, 220/349, 224, 224/296/298, 224/297/299, 224/298/299, 226, 226/234/235/346, 226/234/342, 226/235/268, 226/235/268/342/346, 226/235/268/346, 226/235/272/373, 226/235/342, 226/235/346, 226/268, 226/268/342, 226/268/342/346, 226/268/346, 226/272/373, 226/321/369, 226/342, 226/342/346, 226/346, 226/366, 226/366/369/387, 227, 228, 229, 229/325, 229/360, 230, 231, 232, 232/235, 232/235/273/368, 232/235/321, 232/346/350/355, 233, 233/271, 233/315, 233/367/371, 233/371, 234, 235, 235/268/327/346, 235/268/346, 235/271/272/339, 235/271/272/339/386, 235/271/339, 235/271/339/386, 235/272, 235/272/339, 235/272/386, 235/273, 235/280, 235/280/321/322/324, 235/280/321/324/383/386, 235/315, 235/315/353/355, 235/339, 235/339/386, 235/346, 235/346/350, 235/353, 235/353/355, 236, 237, 237/265, 237/266/360, 237/271, 237/360, 237/381, 238, 239, 241, 241/242/368, 242, 242/244, 242/290, 242/290/297, 242/331, 243, 244, 244/256/261/339/360, 245, 246, 247, 248, 249, 249/315/339, 250, 252, 253, 256, 256/259, 256/360, 257, 258, 259, 259/276/387, 260, 260/327, 260/331, 260/368, 261, 262, 262/325/349, 263, 264, 265, 265/346, 266, 266/297/299, 267, 267/270/275/339/347, 267/272/275, 268, 268/315/327/346, 268/315/346, 268/315/346/366, 268/315/355, 268/324, 268/324/327/346, 268/327/346, 268/346, 268/346/350/353/355, 268/346/355, 268/353, 268/355/366, 269, 270, 270/309, 270/322/344/383, 271, 271/339, 271/380, 272, 273, 273/279, 273/279/373, 274, 275, 275/291, 276, 277, 278, 279, 280, 280/383, 282, 284, 286, 287, 288, 289, 290, 290/303/364, 291, 292, 293, 293/350, 293/350/386, 294, 295, 296, 297, 298, 299, 300, 301, 302, 303, 304, 305, 306, 307, 308, 309, 310, 311, 313, 314, 315, 315/324/327/355/366, 315/327/346, 319, 321, 321/324, 322, 324, 324/327/346, 324/346/350, 324/346/355/366, 324/355, 325, 325/339, 326, 327, 327/346, 328, 330, 331, 332, 338, 339, 341, 342, 342/363, 344, 344/370, 345, 346, 347, 348, 349, 350, 351, 352, 353, 353/355, 355/373, 354, 355, 356, 358, 360, 360/383, 361, 362, 363, 364, 365, 366, 367, 367/371, 368, 369, 370, 371, 372, 373, 374, 376, 377, 378, 380, 381, 382, 383, 384, 385, 386, 387, 388, 390, and 391.

As will be appreciated by the skilled artisan, in some embodiments, one or a combination of residue differences above that is selected can be kept constant (i.e., maintained) in the engineered TdT as a core feature, and additional residue differences at other residue positions incorporated into the sequence to generate additional engineered TdT polypeptides with improved properties. Accordingly, it is to be understood for any engineered TdT containing one or a subset of the residue differences above, the present invention contemplates other engineered TdTs that comprise the one or subset of the residue differences or residue difference sets, and additionally one or more residue differences or residue difference sets at the other residue positions disclosed herein.

As noted above, the engineered TdT polypeptides are also capable of converting substrates (e.g., NTP-3'-O-RBG and an oligo acceptor substrate) to products (e.g., an oligo acceptor substrate with an added NTP-3'-O-RBG). In some embodiments, the engineered TdT polypeptide is capable of converting the substrate compounds to the product compound with at least 1.2 fold, 1.5 fold, 2 fold, 3 fold, 4 fold, 5 fold, 10 fold, 20 fold, 30 fold, 40 fold, 50 fold, 60 fold, 70 fold, 80 fold, 90 fold, 100 fold, or more activity relative to the activity of the reference polypeptide of SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636.

In some embodiments, the engineered TdT capable of converting the substrate compounds to the product compounds with at least 2 fold the activity relative to SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636, comprises an amino acid sequence selected from the even-numbered sequences in SEQ ID NOs: 4-3592 and 3698-6766.

In some embodiments, the engineered TdT has an amino acid sequence comprising one or more residue differences or residue difference sets as compared to SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636, that increases soluble expression of the engineered TdT in a bacterial host cell, particularly in *E. coli*, as compared to a wild-type or engineered reference TdT, comprises an amino acid sequence selected from the even-numbered sequences in SEQ ID NOs: 4-3592 and 3698-6766.

In some embodiments, the engineered TdT has an amino acid sequence comprising one or more residue differences as compared to SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636, that increases the thermostability of the engineered TdT, as compared to a wild-type or engineered reference TdT, comprising an amino acid sequence selected from the even-numbered sequences in SEQ ID NOs: 4-3592 and 3698-6766.

In some embodiments, the engineered TdT has an amino acid sequence comprising at least 60%, 70%, 80%, 85%, 86%, 87%, 88%, 89%, 90%, 91%, 92%, 93%, 94%, 95%, 96%, 97%, 98%, 99% or more sequence identity to a sequence selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and 5636 and comprising one or more residue differences that increase the thermostability of the engineered TdT, as compared to a wild-type or engineered reference TdT selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636.

In some embodiments, the engineered TdT has an amino acid sequence comprising at least 60%, 70%, 80%, 85%, 86%, 87%, 88%, 89%, 90%, 91%, 92%, 93%, 94%, 95%, 96%, 97%, 98%, 99% or more sequence identity to a sequence selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and 5636 and comprising one or more residue differences that increase the thermostability of the engineered TdT by 2-fold, 5-fold, 10-fold, 15-fold, or more, as compared to a wild-type or engineered reference TdT selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636, wherein said one or more residue differences are at one or more positions selected from 80, 87, 203, 111, 143, 147, 157, 160, 180, 203, 209, 226, 256, 261, 266, 279, 327, 339, 349, 353, and 364.

In some embodiments, the engineered TdT has an amino acid sequence comprising at least 60%, 70%, 80%, 85%, 86%, 87%, 88%, 89%, 90%, 91%, 92%, 93%, 94%, 95%, 96%, 97%, 98%, 99% or more sequence identity to a sequence selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and 5636 and comprising one or more residue differences that increase the thermostability of the engineered TdT by 2-fold, 5-fold, 10-fold, 15-fold, or more, as compared to a wild-type or engineered reference TdT selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636, wherein said one or more residue differences comprise 80S, 87S, 103P, 111V, 143A, 147Y, 157A, 157V, 160S, 180A, 203D, 209E, 226L, 256G, 261R, 266G, 279H, 327F, 339M, 349E, 353N, and 364L.

In some embodiments, the engineered TdT has an amino acid sequence comprising at least 60%, 70%, 80%, 85%, 86%, 87%, 88%, 89%, 90%, 91%, 92%, 93%, 94%, 95%, 96%, 97%, 98%, 99% or more sequence identity to a sequence selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and 5636 and comprising one or more residue differences that increase the thermostability of the engineered TdT by 2-fold, 5-fold, 10-fold, 15-fold, or more, as compared to a wild-type or engineered reference TdT selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636, wherein said one or more residue differences comprise Y80S, R87S, D103P, E111V, S143A, F147Y, L157A, L157V, D160S, V180A, L203D, T209E, F226L, C256G, S261R, E266G, F279H, Y327F, E339M, S349E, K353N, R364L.

In some embodiments, the engineered TdT has an amino acid sequence comprising one or more residue differences as compared to SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636, that increases the activity of the engineered TdT at high temperatures, as compared to a wild-type or engineered reference TdT, comprising an amino acid sequence selected from the even-numbered sequences in SEQ ID NOs: 4-3592 and 3698-6766.

In some embodiments, the engineered TdT has an amino acid sequence comprising at least 60%, 70%, 80%, 85%, 86%, 87%, 88%, 89%, 90%, 91%, 92%, 93%, 94%, 95%, 96%, 97%, 98%, 99% or more sequence identity to a sequence selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and 5636 and comprising one or more residue differences that increase the activity of the engineered TdT by 2-fold, 5-fold, 10-fold, 15-fold, or more at 40° C., 45° C., 50° C., 55° C., 60° C., 65° C., 70° C., or 75° C., as compared to a wild-type or engineered reference TdT selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636.

In some embodiments, the engineered TdT has an amino acid sequence comprising at least 60%, 70%, 80%, 85%, 86%, 87%, 88%, 89%, 90%, 91%, 92%, 93%, 94%, 95%, 96%, 97%, 98%, 99% or more sequence identity to a sequence selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and 5636 and comprising one or more residue differences that increase the activity of the engineered TdT by 2-fold, 5-fold, 10-fold, 15-fold, or more at 40° C., 45° C., 50° C., 55° C., 60° C., 65° C., 70° C., or 75° C., as compared to a wild-type or engineered reference TdT selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636, wherein said one or more residue differences are at one or more positions selected from 80, 87, 203, 111, 143, 147, 157, 160, 180, 203, 209, 226, 256, 261, 266, 279, 327, 339, 349, 353, and 364.

In some embodiments, the engineered TdT has an amino acid sequence comprising at least 60%, 70%, 80%, 85%, 86%, 87%, 88%, 89%, 90%, 91%, 92%, 93%, 94%, 95%, 96%, 97%, 98%, 99% or more sequence identity to a sequence selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and 5636 and comprising one or more residue differences that increase the activity of the engineered TdT at 40° C., 45° C., 50° C., 55° C., 60° C., 65° C., 70° C., or 75° C., as compared to a wild-type or engineered reference TdT selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636, wherein said one or more residue differences comprise residue differences of 80S, 87S, 103P, 111V, 143A, 147Y, 157A, 157V, 160S, 180A, 203D, 209E, 226L, 256G, 261R, 266G, 279H, 327F, 339M, 349E, 353N, and 364L.

In some embodiments, the engineered TdT has an amino acid sequence comprising at least 60%, 70%, 80%, 85%, 86%, 87%, 88%, 89%, 90%, 91%, 92%, 93%, 94%, 95%, 96%, 97%, 98%, 99% or more sequence identity to a sequence selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and 5636 and comprising one or more residue differences that increase the activity of the engineered TdT at 40° C., 45° C., 50° C., 55° C., 60° C., 65° C., 70° C., or 75° C., as compared to a wild-type or engineered reference TdT selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636, wherein said one or more residue differences comprise Y80S, R87S, D103P, E111V, S143A, F147Y, L157A, L157V, D160S, V180A, L203D, T209E, F226L, C256G, S261R, E266G, F279H, Y327F, E339M, S349E, K353N, R364L.

In some embodiments, the engineered TdT has an amino acid sequence comprising one or more residue differences as compared to SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636, that reduce the by-product formation of the engineered TdT, as compared to a wild-type or engineered reference TdT, comprising an amino acid sequence selected from the even-numbered sequences in SEQ ID NOs: 4-3592 and 3698-6766.

In some embodiments, the engineered TdT has an amino acid sequence comprising at least 60%, 70%, 80%, 85%, 86%, 87%, 88%, 89%, 90%, 91%, 92%, 93%, 94%, 95%, 96%, 97%, 98%, 99% or more sequence identity to a sequence selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and 5636 and comprising one or more residue differences that reduce the by-product formation of the engineered TdT, as compared to a wild-type or engineered reference TdT selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636.

In some embodiments, the engineered TdT has an amino acid sequence comprising at least 60%, 70%, 80%, 85%, 86%, 87%, 88%, 89%, 90%, 91%, 92%, 93%, 94%, 95%, 96%, 97%, 98%, 99% or more sequence identity to a sequence selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and 5636 and comprising one or more residue differences that reduce the by-product formation of the engineered TdT, as compared to a wild-type or engineered reference TdT selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636, wherein said one or more residue differences are at one or more positions selected from 53, 65, 68, 159, 211, 217, 224, 271, 272, 273, 275,278, 331, 341, 391.

In some embodiments, the engineered TdT has an amino acid sequence comprising at least 60%, 70%, 80%, 85%, 86%, 87%, 88%, 89%, 90%, 91%, 92%, 93%, 94%, 95%, 96%, 97%, 98%, 99% or more sequence identity to a sequence selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and 5636 and comprising one or more residue differences that reduce the by-product formation of the engineered TdT, as compared to a wild-type or engineered reference TdT selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636, wherein said one or more residue differences comprise 53T, 65L, 68R, 159R, 211V, 217R, 224V, 271H, 271P, 272A, 273P, 275Q, 278G, 331K, 341R, 391L.

In some embodiments, the engineered TdT has an amino acid sequence comprising at least 60%, 70%, 80%, 85%, 86%, 87%, 88%, 89%, 90%, 91%, 92%, 93%, 94%, 95%, 96%, 97%, 98%, 99% or more sequence identity to a sequence selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and 5636 and comprising one or more residue differences that reduce the by-product formation of the engineered TdT, as compared to a wild-type or engineered reference TdT selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636, wherein said one or more residue differences comprise E53T, E65L, C68R, A159R, T211V, G217R, I224V, R271H, R271P, K272A, I273P, A275Q, N278G, L331K, G341R, E391L.

In some embodiments, the engineered TdT has an amino acid sequence comprising one or more residue differences as compared to SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636, that increases specific activity of the engineered TdT on one or more NTP-3'-O-RBG substrates, as compared to a wild-type or engineered reference TdT, comprises an amino acid sequence selected from the even-numbered sequences in SEQ ID NOs: 4-3592 and 3698-6766.

In some embodiments, the engineered TdT has an amino acid sequence comprising one or more residue differences as compared to SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636, that increases specific activity of the engineered TdT on one or more oligo acceptor substrates, as compared to a wild-type or engineered reference TdT, comprises an amino acid sequence selected from the even-numbered sequences in SEQ ID NOs: 4-3592 and 3698-6766.

In some embodiments, the engineered TdT has an amino acid sequence comprising at least 60%, 70%, 80%, 85%, 86%, 87%, 88%, 89%, 90%, 91%, 92%, 93%, 94%, 95%, 96%, 97%, 98%, 99% or more sequence identity to a sequence selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and 5636 and comprising one or more residue differences that increase conversion of the substrate to product by the engineered TdT to a rate of 5%, 20%, 30%, 40%, 50%, 60%, 70%, 80%, 90%, 95% or more, as compared to a wild-type or engineered reference TdT selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636.

In some embodiments, the engineered TdT has an amino acid sequence comprising at least 60%, 70%, 80%, 85%, 86%, 87%, 88%, 89%, 90%, 91%, 92%, 93%, 94%, 95%, 96%, 97%, 98%, 99% or more sequence identity to a sequence selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and 5636 and comprising one or more residue differences that increase conversion of the substrate to product by the engineered TdT to a rate of 5%, 20%, 30%, 40%, 50%, 60%, 70%, 80%, 90%, 95% or more, as compared to a wild-type or engineered reference TdT selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636, wherein said one or more residue differences are at one or more positions selected from 53, 65, 68, 159, 211, 217, 224, 271, 272, 273, 275,278, 331, 341, 391.

In some embodiments, the engineered TdT has an amino acid sequence comprising at least 60%, 70%, 80%, 85%, 86%, 87%, 88%, 89%, 90%, 91%, 92%, 93%, 94%, 95%, 96%, 97%, 98%, 99% or more sequence identity to a sequence selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and 5636 and comprising one or more residue differences that increase conversion of the substrate to product by the engineered TdT to a rate of 5%, 20%, 30%, 40%, 50%, 60%, 70%, 80%, 90%, 95% or more, as compared to a wild-type or engineered reference TdT selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636, wherein said one or more residue differences comprise 53T, 65L, 68R, 159R, 211V, 217R, 224V, 271H, 271P, 272A, 273P, 275Q, 278G, 331K, 341R, 391L.

In some embodiments, the engineered TdT has an amino acid sequence comprising at least 60%, 70%, 80%, 85%, 86%, 87%, 88%, 89%, 90%, 91%, 92%, 93%, 94%, 95%, 96%, 97%, 98%, 99% or more sequence identity to a sequence selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and 5636 and comprising one or more residue differences that increase conversion of the substrate to product by the engineered TdT to a rate of 5%, 20%, 30%, 40%, 50%, 60%, 70%, 80%, 90%, 95% or more, as compared to a wild-type or engineered reference TdT selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636, wherein said one or more residue differences comprise E53T, E65L, C68R, A159R, T211V, G217R, I224V, R271H, R271P, K272A, I273P, A275Q, N278G, L331K, G341R, E391L.

In some embodiments, the engineered TdT with improved properties has an amino acid sequence comprising a sequence selected from the even-numbered sequences in the range of SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636.

In some embodiments, the engineered TdT with improved properties has an amino acid sequence comprising a sequence selected from selected from the even-numbered sequences in SEQ ID NOs: 4-3592 and 3698-6766.

In some embodiments, the engineered TdT, comprises an amino acid sequence having at least 60%, 70%, 80%, 85%, 86%, 87%, 88%, 89%, 90%, 91%, 92%, 93%, 94%, 95%, 96%, 97%, 98%, or 99% identity to one of the even-numbered sequences in the range of SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636, as provided in the Examples.

In addition to the residue positions specified above, any of the engineered TdT polypeptides disclosed herein can further comprise other residue differences or residue difference sets relative to SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636, at other residue positions (i.e., residue positions other than those included herein). Residue differences or residue difference sets at these other residue positions can provide for additional variations in the amino acid sequence without adversely affecting the ability of the polypeptide to carry out the conversion of substrate to product. Accordingly, in some embodiments, in addition to the amino acid residue differences or residue difference sets present in any one of the engineered TdTs polypeptides selected from the even-numbered sequences in the range of SEQ ID NOs: 4-3592 and 3698-6766, the sequence can further comprise 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-100, or 1-150 residue differences at other amino acid residue positions as compared to the SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636. In some embodiments, the number of amino acid residue differences as compared to the reference sequence can be 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, 50, 100, or 150 residue positions. In some embodiments, the number of amino acid residue differences as compared to the reference sequence can be 1, 2, 3, 4, 5, 6, 7, 8, 9, 10, 11, 12, 13, 14, 15, 16, 18, 20, 21, 22, 23, 24, or 25 residue positions. The residue differences at these other positions can be conservative changes or non-conservative changes. In some embodiments, the residue differences can comprise conservative substitutions and non-conservative substitutions as compared to the TdT polypeptide of SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636.

In some embodiments, the present invention also provides engineered polypeptides that comprise a fragment of any of the engineered TdT polypeptides described herein that retains the functional activity and/or improved property of that engineered TdT. Accordingly, in some embodiments, the present invention provides a polypeptide fragment capable of converting substrate to product under suitable reaction conditions, wherein the fragment comprises at least about 90%, 95%, 96%, 97%, 98%, or 99% of a full-length or truncated amino acid sequence of an engineered TdT of the present invention, such as an exemplary TdT polypeptide selected from the even-numbered sequences in the range of SEQ ID NOs: 4-3592 and 3698-6766. In some embodiments, the engineered TdT can have an amino acid sequence comprising a deletion in any one of the TdT polypeptide sequences described herein, such as the exemplary engineered polypeptides of the even-numbered sequences in the range of SEQ ID NOs: 4-3592 and 3698-6766.

Thus, for each and every embodiment of the engineered TdT polypeptides of the invention, the amino acid sequence can comprise deletions of one or more amino acids, 2 or more amino acids, 3 or more amino acids, 4 or more amino acids, 5 or more amino acids, 6 or more amino acids, 8 or more amino acids, 10 or more amino acids, 15 or more amino acids, or 20 or more amino acids, up to 10% of the total number of amino acids, up to 20% of the total number of amino acids, or up to 30% of the total number of amino acids of the TdT polypeptides, where the associated functional activity and/or improved properties of the engineered TdT described herein are maintained. In some embodiments, the deletions can comprise 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1- 45, or 1-50 amino acid residues. In some embodiments, the number of deletions can be 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, or 50 amino acid residues. In some embodiments, the deletions can comprise deletions of 1, 2, 3, 4, 5, 6, 7, 8, 9, 10, 11, 12, 13, 14, 15, 16, 18, 20, 21, 22, 23, 24, or 25 amino acid residues.

In some embodiments, the engineered TdT polypeptide herein can have an amino acid sequence comprising an insertion as compared to any one of the engineered TdT polypeptides described herein, such as the exemplary engineered polypeptides of the even-numbered sequences in the range of SEQ ID NOs: 4-3592 and 3698-6766. Thus, for each and every embodiment of the TdT polypeptides of the invention, the insertions can comprise one or more amino acids, 2 or more amino acids, 3 or more amino acids, 4 or more amino acids, 5 or more amino acids, 6 or more amino acids, 8 or more amino acids, 10 or more amino acids, 15 or more amino acids, 20 or more amino acids, 30 or more amino acids, 40 or more amino acids, or 50 or more amino acids, where the associated functional activity and/or improved properties of the engineered TdT described herein is maintained. The insertions can be to amino or carboxy terminus, or internal portions of the TdT polypeptide.

In some embodiments, the engineered TdT described herein can have an amino acid sequence comprising a sequence selected from the even-numbered sequences in the range of SEQ ID NOs: 4-3592 and 3698-6766, and optionally one or several (e.g., up to 3, 4, 5, or up to 10) amino acid residue deletions, insertions and/or substitutions. In some embodiments, the amino acid sequence has optionally 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, 1-50, 1-75, 1-100, or 1-150 amino acid residue deletions, insertions and/or substitutions. In some embodiments, the amino acid sequence has optionally around 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, 50, 55, 60, 65, 70, 80, 90, 100, 110, 120, 130, 140, or 150 amino acid residue deletions, insertions and/or substitutions. In some embodiments, the substitutions can be conservative or non-conservative substitutions.

In the above embodiments, the suitable reaction conditions for the engineered polypeptides are provided in Tables 7.1, 8.1, 9.1, 10.1, 11.1, 12.1, 13.1, 14.1, 15.1, 16.1, 17.1, 18.1, 19.1, 20.1, 21.1, 22.1, 23.1, 24.1, 25.1, 26.1, 27.1, 28.1, 29.1, 30.1, 31.1, 32.1, 33.1, 34.1, 35.1, 36.1, 37.1, 38.1, 39.1, 40.1, 41.1, 42.1, 43.1, 44.1, 45.1, 46.1, 47.1, 48.1, 49.1, 50.1, 51.1, 52.1, 53.1, 54.1, 55.1, 56.1, 57.1, 58.1, 59.1, 60.1, 61.1, 62.1, 63.1, 64.1, 65.1, 66.1, 74.1, 75.1, 76.1, 77.1, 78.1, 79.1, 80.1, 81.1, 82.1, 83.1, 84.1, 85.1, 86.1, 87.1, 88.1, 89.1, 90.1, 91.1, 92.1, 93.1, 94.1, 95.1, 96.1, 97.1, 98.1, 99.1, 100.1, 101.1, 102.1, 103.1, 104.1, 105.1, 106.1, 107.1, and/or 108.1, and as described in the Examples herein.

In some embodiments, the polypeptides of the present invention are fusion polypeptides in which the engineered polypeptides are fused to other polypeptides, such as, by way of example and not limitation, antibody tags (e.g., myc epitope), purification sequences (e.g., His tags for binding to metals), and cell localization signals (e.g., secretion signals). Thus, the engineered polypeptides described herein can be used with or without fusions to other polypeptides.

It is to be understood that the polypeptides described herein are not restricted to the genetically encoded amino acids. In addition to the genetically encoded amino acids, the polypeptides described herein may be comprised, either in whole or in part, of naturally occurring and/or synthetic non-encoded amino acids. Certain commonly encountered non-encoded amino acids of which the polypeptides described herein may be comprised include, but are not limited to: the D-stereoisomers of the genetically-encoded amino acids; 2,3-diaminopropionic acid (Dpr); α-aminoisobutyric acid (Aib); ε-aminohexanoic acid (Aha); δ-aminovaleric acid (Ava); N-methylglycine or sarcosine (MeGly or Sar); ornithine (Orn); citrulline (Cit); t-butylalanine (Bua); t-butylglycine (Bug); N-methylisoleucine (MeIle); phenylglycine (Phg); cyclohexylalanine (Cha); norleucine (Nle); naphthylalanine (Nal); 2-chlorophenylalanine (Ocf); 3-chlorophenylalanine (Mcf); 4-chlorophenylalanine (Pcf); 2-fluorophenylalanine (Off); 3-fluorophenylalanine (Mff); 4-fluorophenylalanine (Pff); 2-bromophenylalanine (Obf); 3-bromophenylalanine (Mbf); 4-bromophenylalanine (Pbf); 2-methylphenylalanine (Omf); 3-methylphenylalanine (Mmf); 4-methylphenylalanine (Pmf); 2-nitrophenylalanine (Onf); 3-nitrophenylalanine (Mnf); 4-nitrophenylalanine (Pnf); 2-cyanophenylalanine (Ocf); 3-cyanophenylalanine (Mcf); 4-cyanophenylalanine (Pcf); 2-trifluoromethylphenylalanine (Otf); 3-trifluoromethylphenylalanine (Mtf); 4-trifluoromethylphenylalanine (Ptf); 4-aminophenylalanine (Paf); 4-iodophenylalanine (Pif); 4-aminomethylphenylalanine (Pamf); 2,4-dichlorophenylalanine (Opef); 3,4-dichlorophenylalanine (Mpcf); 2,4-difluorophenylalanine (Opff); 3,4-difluorophenylalanine (Mpff); pyrid-2-ylalanine (2pAla); pyrid-3-ylalanine (3pAla); pyrid-4-ylalanine (4pAla); naphth-1-ylalanine (1nAla); naphth-2-ylalanine (2nAla); thiazolylalanine (taAla); benzothienylalanine (bAla); thienylalanine (tAla); furylalanine (fAla); homophenylalanine (hPhe); homotyrosine (hTyr); homotryptophan (hTrp); pentafluorophenylalanine (5ff); styrylkalanine (sAla); authrylalanine (aAla); 3,3-diphenylalanine (Dfa); 3-amino-5-phenypentanoic acid (Afp); penicillamine (Pen); 1,2,3,4-tetrahydroisoquinoline-3-carboxylic acid (Tic); β-2-thienylalanine (Thi); methionine sulfoxide (Mso); N(w)-nitroarginine (nArg); homolysine (hLys); phosphonomethylphenylalanine (pmPhe); phosphoserine (pSer); phosphothreonine (pThr); homoaspartic acid (hAsp); homoglutanic acid (hGlu); 1-aminocyclopent-(2 or 3)-ene-4 carboxylic acid; pipecolic acid (PA), azetidine-3-carboxylic acid (ACA); 1-aminocyclopentane-3-carboxylic acid; allylglycine (aGly); propargylglycine (pgGly); homoalanine (hAla); norvaline (nVal); homoleucine (hLeu), homovaline (hVal); homoisoleucine (hIle); homoarginine (hArg); N-acetyl lysine (AcLys); 2,4-diaminobutyric acid (Dbu); 2,3-diaminobutyric acid (Dab); N-methylvaline (MeVal); homocysteine (hCys); homoserine (hSer); hydroxyproline (Hyp) and homoproline (hPro). Additional non-encoded amino acids of which the polypeptides described herein may be comprised will be apparent to those of skill in the art (See e.g., the various amino acids provided in Fasman, *CRC Practical Handbook of Biochemistry and Molecular Biology*, CRC Press, Boca Raton, FL, pp. 3-70 [1989], and the references cited therein, all of which are incorporated by reference). These amino acids may be in either the L- or D-configuration.

Those of skill in the art will recognize that amino acids or residues bearing side chain protecting groups may also comprise the polypeptides described herein. Non-limiting examples of such protected amino acids, which in this case belong to the aromatic category, include (protecting groups listed in parentheses), but are not limited to: Arg (tos), Cys (methylbenzyl), Cys (nitropyridinesulfenyl), Glu (δ-benzylester), Gln (xanthyl), Asn (N-δ-xanthyl), His (bom), His (benzyl), His (tos), Lys (fmoc), Lys (tos), Ser (O-benzyl), Thr (O-benzyl) and Tyr (O-benzyl).

Non-encoding amino acids that are conformationally constrained of which the polypeptides described herein may be composed include, but are not limited to, N-methyl amino acids (L-configuration); 1-aminocyclopent-(2 or 3)-ene-4-carboxylic acid; pipecolic acid; azetidine-3-carboxylic acid; homoproline (hPro); and 1-aminocyclopentane-3-carboxylic acid.

In some embodiments, the engineered polypeptides can be in various forms, for example, such as an isolated preparation, as a substantially purified enzyme, whole cells transformed with gene(s) encoding the enzyme, and/or as cell extracts and/or lysates of such cells. The enzymes can be lyophilized, spray-dried, precipitated or be in the form of a crude paste, as further discussed below.

In some embodiments, the engineered polypeptides can be in the form of a biocatalytic composition. In some embodiments, the biocatalytic composition comprises (a) a means for conversion of a NTP-3-O-RBG and an oligo acceptor compound to an oligo acceptor product extended by one NTP by contact with a TdT and (b) a suitable cofactor. The suitable cofactor may be cobalt, manganese, or any other suitable cofactor.

In some embodiments, the engineered polypeptides can be provided on a solid support, such as a membrane, resin, solid carrier, or other solid phase material. A solid support can be composed of organic polymers such as polystyrene, polyethylene, polypropylene, polyfluoroethylene, polyethyleneoxy, and polyacrylamide, as well as co-polymers and grafts thereof. A solid support can also be inorganic, such as glass, silica, controlled pore glass (CPG), reverse phase silica or metal, such as gold or platinum. The configuration of a solid support can be in the form of beads, spheres, particles, granules, a gel, a membrane or a surface. Surfaces can be planar, substantially planar, or non-planar. Solid supports can be porous or non-porous, and can have swelling or non-swelling characteristics. A solid support can be configured in the form of a well, depression, or other container, vessel, feature, or location.

In some embodiments, the engineered TdT polypeptides of the present invention can be immobilized on a solid support such that they retain their improved activity, and/or other improved properties relative to the reference polypeptide of SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636. In such embodiments, the immobilized polypeptides can facilitate the biocatalytic conversion of the substrate compounds or other suitable substrates to the product and after the reaction is complete are easily retained (e.g., by retaining beads on which polypeptide is immobilized) and then reused or recycled in subsequent reactions. Such immobilized enzyme processes allow for further efficiency and cost reduction. Accordingly, it is further contemplated that any of the methods of using the TdT polypeptides of the present invention can be carried out using the TdT polypeptides bound or immobilized on a solid support.

Methods of enzyme immobilization are well-known in the art. The engineered polypeptides can be bound non-covalently or covalently. Various methods for conjugation and immobilization of enzymes to solid supports (e.g., resins, membranes, beads, glass, etc.) are well known in the art (See e.g., Yi et al., Proc. Biochem., 42(5): 895-898 [2007]; Martin et al., Appl. Microbiol. Biotechnol., 76(4): 843-851 [2007]; Koszelewski et al., J. Mol. Cat. B: Enzymatic, 63: 39-44 [2010]; Truppo et al., Org. Proc. Res. Dev., published online: dx.doi.org/10.1021/op200157c; Hermanson, *Bioconjugate Techniques,* $2^{nd}$ ed., Academic Press, Cambridge, MA [2008]; Mateo et al., Biotechnol. Prog., 18(3):629-34 [2002]; and "Bioconjugation Protocols: Strategies and Methods," In *Methods in Molecular Biology*, Niemeyer (ed.), Humana Press, New York, NY [2004]; the disclosures of each which are incorporated by reference herein). Solid supports useful for immobilizing the engineered TdT of the present invention include but are not limited to beads or resins comprising polymethacrylate with epoxide functional groups, polymethacrylate with amino epoxide functional groups, styrene/DVB copolymer or polymethacrylate with octadecyl functional groups. Exemplary solid supports useful for immobilizing the engineered TdT polypeptides of the present invention include, but are not limited to, chitosan beads, Eupergit C, and SEPABEADs (Mitsubishi), including the following different types of SEPABEAD: EC-EP, EC-HFA/S, EXA252, EXE119 and EXE120.

In some embodiments, the polypeptides described herein are provided in the form of kits. The enzymes in the kits may be present individually or as a plurality of enzymes. The kits can further include reagents for carrying out the enzymatic reactions, substrates for assessing the activity of enzymes, as well as reagents for detecting the products. The kits can also include reagent dispensers and instructions for use of the kits.

In some embodiments, the kits of the present invention include arrays comprising a plurality of different TdT polypeptides at different addressable position, wherein the different polypeptides are different variants of a reference sequence each having at least one different improved enzyme property. In some embodiments, a plurality of polypeptides immobilized on solid supports are configured on an array at various locations, addressable for robotic delivery of reagents, or by detection methods and/or instruments. The array can be used to test a variety of substrate compounds for conversion by the polypeptides. Such arrays comprising a plurality of engineered polypeptides and methods of their use are known in the art (See e.g., WO2009/008908A2).

Polynucleotides Encoding Engineered Terminal Deoxynucleotidyl Transferases, Expression Vectors and Host Cells In another aspect, the present invention provides polynucleotides encoding the engineered TdT polypeptides described herein. The polynucleotides may be operatively linked to one or more heterologous regulatory sequences that control gene expression to create a recombinant polynucleotide capable of expressing the polypeptide. Expression constructs containing a heterologous polynucleotide encoding the engineered TdT are introduced into appropriate host cells to express the corresponding TdT polypeptide.

As will be apparent to the skilled artisan, availability of a protein sequence and the knowledge of the codons corresponding to the various amino acids provide a description of all the polynucleotides capable of encoding the subject polypeptides. The degeneracy of the genetic code, where the same amino acids are encoded by alternative or synonymous codons, allows an extremely large number of nucleic acids to be made, all of which encode the improved TdT enzymes. Thus, having knowledge of a particular amino acid sequence, those skilled in the art could make any number of different nucleic acids by simply modifying the sequence of one or more codons in a way which does not change the amino acid sequence of the protein. In this regard, the present invention specifically contemplates each and every possible variation of polynucleotides that could be made encoding the polypeptides described herein by selecting combinations based on the possible codon choices, and all such variations are to be considered specifically disclosed for any polypeptide described herein, including the amino acid sequences presented in Tables 7.2, 8.2, 9.2, 10.2, 11.2, 12.2, 13.2, 14.2, 15.2, 16.2, 17.2, 18.2, 19.2, 20.2, 21.2, 22.2, 23.2, 24.2, 25.2, 26.2, 27.2, 28.2, 29.2, 30.2, 31.2, 32.2, 33.2, 34.2, 35.2, 36.2, 37.2, 38.2, 39.2, 40.2, 41.2, 42.2, 43.2, 44.2, 45.2, 46.2, 47.2, 48.2, 49.2, 50.2, 51.2, 52.2, 53.2, 54.2, 55.2, 56.2, 57.2, 58.2, 59.2, 60.2, 61.2, 62.2, 63.2, 64.2, 65.2, 66.2, 74.2, 75.2, 76.2, 77.2, 78.2, 79.2, 80.2, 81.2, 82.2, 83.2, 84.2, 85.2, 86.2, 87.2, 88.2, 89.2, 90.2, 91.2, 92.2, 93.2, 94.2, 95.2, 96.2, 97.2, 98.2, 99.2, 100.2, 101.2, 102.2, 103.2, 104.2, 105.2, 106.2, 107.2, and 108.2, and disclosed in the sequence listing incorporated by reference herein as the even-numbered sequences in the range of SEQ ID NOs: 4-3592 and 3698-6766.

In various embodiments, the codons are preferably selected to fit the host cell in which the protein is being produced. For example, preferred codons used in bacteria are used to express the gene in bacteria; preferred codons used in yeast are used for expression in yeast; and preferred codons used in mammals are used for expression in mammalian cells. In some embodiments, all codons need not be replaced to optimize the codon usage of the TdT since the natural sequence will comprise preferred codons and because use of preferred codons may not be required for all amino acid residues. Consequently, codon optimized polynucleotides encoding the TdT enzymes may contain preferred codons at about 40%, 50%, 60%, 70%, 80%, or greater than 90% of codon positions of the full length coding region.

In some embodiments, the polynucleotide comprises a codon optimized nucleotide sequence encoding the TdT polypeptide amino acid sequence, as represented by SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636. In some embodiments, the polynucleotide has a nucleic acid sequence comprising at least 60%, 70%, 80%, 85%, 90%, 91%, 92%, 93%, 94%, 95%, 96%, 97%, 98%, 99% or more identity to the codon optimized nucleic acid sequences encoding the even-numbered sequences in the range of SEQ ID NOs: 4-3592 and 3698-6766. In some embodiments, the polynucleotide has a nucleic acid sequence comprising at least 60%, 70%, 80%, 85%, 90%, 91%, 92%, 93%, 94%, 95%, 96%, 97%, 98%, 99% or more identity to the codon optimized nucleic acid sequences in the odd-numbered sequences in the range of SEQ ID NOs: 5-3591 and 3697-6765. In some embodiments, the codon optimized sequences of the odd-numbered sequences in the range of SEQ ID NOs: 5-3591 and 3697-6765, enhance expression of the encoded TdT, providing preparations of enzyme capable of converting substrate to product.

In some embodiments, the polynucleotides are capable of hybridizing under highly stringent conditions to a reference sequence selected from the odd-numbered sequences in SEQ ID NOs: 5-3591 and 3697-6765, or a complement thereof, and encode a TdT.

In some embodiments, as described above, the polynucleotide encodes an engineered TdT polypeptide with improved properties as compared to SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636, wherein the polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more identity to a reference sequence selected from SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636, and one or more residue differences or residue difference sets as compared to SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636, wherein the sequence is selected from the even-numbered sequences in the range of SEQ ID NOs: 4-3591 and 3698-6766. In some embodiments, the reference amino acid sequence is selected from the even-numbered sequences in the range of SEQ ID NOs: 4-3592 and 3698-6766. In some embodiments, the reference amino acid sequence is SEQ ID NO: 4, while in some other embodiments, the reference sequence is SEQ ID NO: 580, while in some other embodiments, the reference sequence is SEQ ID NO: 692. In some embodiments, the reference amino acid sequence is SEQ ID NO: 882, while in some other embodiments, the reference sequence is SEQ ID NO: 914, while in some other embodiments, the reference sequence is SEQ ID NO: 1034. In some embodiments, the reference amino acid sequence is SEQ ID NO: 1270, while in some other embodiments, the reference sequence is SEQ ID NO: 1344, while in some other embodiments, the reference sequence is SEQ ID NO: 1346. In some embodiments, the reference amino acid sequence is SEQ ID NO: 1678, while in some other embodiments, the reference sequence is SEQ ID NO: 1700, while in some other embodiments, the reference sequence is SEQ ID NO: 1750. In some embodiments, the reference amino acid sequence is SEQ ID NO: 1932, while in some other embodiments, the reference sequence is SEQ ID NO: 2164, while in some other embodiments, the reference sequence is SEQ ID NO: 2666. In some embodiments, the reference amino acid sequence is SEQ ID NO: 2794, while in some other embodiments, the reference sequence is SEQ ID NO: 2978, while in some other embodiments, the reference sequence is SEQ ID NO: 3074. In some embodiments, the reference amino acid sequence is SEQ ID NO: 3302, while in some other embodiments, the reference sequence is SEQ ID NO: 3398. In some embodiments, the reference amino acid sequence is SEQ ID NO: 3488, while in some other embodiments, the reference sequence is SEQ ID NO: 3958. In some embodiments, the reference amino acid sequence is SEQ ID NO: 3788, while in some other embodiments, the reference sequence is SEQ ID NO: 4124, while in some other embodiments, the reference sequence is SEQ ID NO: 4226. In some embodiments, the reference amino acid sequence is SEQ ID NO: 4734, while in some other embodiments, the reference sequence is SEQ ID NO: 5052, while in some other embodiments, the reference sequence is SEQ ID NO: 5152. In some embodiments, the reference amino acid sequence is SEQ ID NO: 5252, while in some other embodiments, the reference sequence is SEQ ID NO: 5296, while in some other embodiments, the reference sequence is SEQ ID NO: 5628. In some embodiments, the reference amino acid sequence is SEQ ID NO: 5630, while in some other embodiments, the reference sequence is SEQ ID NO: 5632, while in some other embodiments, the reference sequence is SEQ ID NO: 5636.

In some embodiments, the polynucleotide encodes a TdT polypeptide capable of converting one or more substrates to product with improved properties as compared to SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636, wherein the polypeptide comprises an amino acid sequence having at least 60%, 70%, 80%, 85%, 86%, 87%, 88%, 89%, 90%, 91%, 92%, 93%, 94%, 95%, 96%, 97%, 98%, 99% or more sequence identity to reference sequence SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636.

In some embodiments, the polynucleotide encoding the engineered TdT comprises a polynucleotide sequence selected from the odd-numbered sequences in the range of SEQ ID NOs: 5-3591 and 5-3592 and 3697-6765.

In some embodiments, the polynucleotides are capable of hybridizing under highly stringent conditions to a reference polynucleotide sequence selected from the odd-numbered sequences in the range of SEQ ID NOs: 5-3592 and 3697-6765 or a complement thereof, and encode a TdT polypeptide with one or more of the improved properties described herein. In some embodiments, the polynucleotide capable of hybridizing under highly stringent conditions encodes a TdT comprising an amino acid sequence having at least 60%, 70%, 80%, 85%, 86%, 87%, 88%, 89%, 90%, 91%, 92%, 93%, 94%, 95%, 96%, 97%, 98%, 99% or more identity to SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636, that has an amino acid sequence comprising one or more residue differences or residue difference sets as compared to SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636, as described above and in the Examples, below.

In some embodiments, the polynucleotide capable of hybridizing under highly stringent conditions encodes an engineered TdT polypeptide with improved properties comprising an amino acid sequence having at least 60%, 70%, 80%, 85%, 86%, 87%, 88%, 89%, 90%, 91%, 92%, 93%, 94%, 95%, 96%, 97%, 98%, 99% or more identity to SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636. In some embodiments, the polynucleotides encode the polypeptides described herein but have at least about 60%, 70%, 80%, 85%, 86%, 87%, 88%, 89%, 90%, 91%, 92%, 93%, 94%, 95%, 96%, 97%, 98%, or 99% or more sequence identity at the nucleotide level to a reference polynucleotide encoding the engineered TdT. In some embodiments, the reference polynucleotide sequence is selected from SEQ ID NOs: 5-3591 and 3697-6765.

In some embodiments, the polynucleotide capable of hybridizing under highly stringent conditions encodes an engineered TdT polypeptide with improved properties comprising an amino acid sequence having at least 60%, 70%, 80%, 85%, 86%, 87%, 88%, 89%, 90%, 91%, 92%, 93%, 94%, 95%, 96%, 97%, 98%, 99% or more identity to SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636. In some embodiments, the polynucleotides encode the polypeptides described herein but have at least about 60%, 70%, 80%, 85%, 86%, 87%, 88%, 89%, 90%, 91%, 92%, 93%, 94%, 95%, 96%, 97%, 98%, or 99% or more sequence identity at the nucleotide level to a reference polynucleotide encoding the engineered TdT. In some embodiments, the reference polynucleotide sequence is selected from SEQ ID NOs: 3-3591 and 3697-6765.

In some embodiments, an isolated polynucleotide encoding any of the engineered TdT polypeptides provided herein is manipulated in a variety of ways to provide for expression of the polypeptide. In some embodiments, the polynucleotides encoding the polypeptides are provided as expression vectors where one or more control sequences is present to regulate the expression of the polynucleotides and/or polypeptides. Manipulation of the isolated polynucleotide prior to its insertion into a vector may be desirable or necessary depending on the expression vector. The techniques for modifying polynucleotides and nucleic acid sequences utilizing recombinant DNA methods are well known in the art.

In some embodiments, the control sequences include among other sequences, promoters, leader sequences, polyadenylation sequences, propeptide sequences, signal peptide sequences, and transcription terminators. As known in the art, suitable promoters can be selected based on the host cells used. For bacterial host cells, suitable promoters for directing transcription of the nucleic acid constructs of the present application, include, but are not limited to the promoters obtained from the *E. coli* lac operon, *Streptomyces coelicolor* agarase gene (dagA), *Bacillus subtilis* levansucrase gene (sacB), *Bacillus* lichenformis alpha-amylase gene (amyL), *Bacillus stearothermophilus* maltogenic amylase gene (amyM), *Bacillus amyloliquefaciens* alpha-amylase gene (amyQ), *Bacillus* lichenformis penicillinase gene (penP), *Bacillus subtilis* xylA and xylB genes, and prokaryotic beta-lactamase gene (See e.g., Villa-Kamaroff et al., Proc. Natl Acad. Sci. USA 75: 3727-3731 [1978]), as well as the tac promoter (See e.g., DeBoer et al., Proc. Natl Acad. Sci. USA 80: 21-25 [1983]). Exemplary promoters for filamentous fungal host cells, include promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (See e.g., WO 96/00787), as well as the NA2-tpi promoter (a hybrid of the promoters from the genes for *Aspergillus niger* neutral alpha-amylase and *Aspergillus oryzae* triose phosphate isomerase), and mutant, truncated, and hybrid promoters thereof. Exemplary yeast cell promoters can be from the genes can be from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH2/GAP), and *Saccharomyces cerevisiae* 3-phosphoglycerate kinase. Other useful promoters for yeast host cells are known in the art (See e.g., Romanos et al., Yeast 8:423-488 [1992]).

In some embodiments, the control sequence is a suitable transcription terminator sequence, a sequence recognized by a host cell to terminate transcription. The terminator sequence is operably linked to the 3' terminus of the nucleic acid sequence encoding the polypeptide. Any terminator which is functional in the host cell of choice finds use in the present invention. For example, exemplary transcription terminators for filamentous fungal host cells can be obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease. Exemplary terminators for yeast host cells can be obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are known in the art (See e.g., Romanos et al., supra).

In some embodiments, the control sequence is a suitable leader sequence, a non-translated region of an mRNA that is important for translation by the host cell. The leader sequence is operably linked to the 5' terminus of the nucleic acid sequence encoding the polypeptide. Any leader sequence that is functional in the host cell of choice may be used. Exemplary leaders for filamentous fungal host cells are obtained from the genes for *Aspergillus oryzae* TAKA amylase and *Aspergillus nidulans* triose phosphate isomerase. Suitable leaders for yeast host cells include, but are not limited to those obtained from the genes for *Sac-*

*charomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP). The control sequence may also be a polyadenylation sequence, a sequence operably linked to the 3' terminus of the nucleic acid sequence and which, when transcribed, is recognized by the host cell as a signal to add polyadenosine residues to transcribed mRNA. Any polyadenylation sequence which is functional in the host cell of choice may be used in the present invention. Exemplary polyadenylation sequences for filamentous fungal host cells include, but are not limited to those from the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase. Useful polyadenylation sequences for yeast host cells are also known in the art (See e.g., Guo and Sherman, Mol. Cell. Bio., 15:5983-5990 [1995]).

In some embodiments, the control sequence is a signal peptide coding region that codes for an amino acid sequence linked to the amino terminus of a polypeptide and directs the encoded polypeptide into the cell's secretory pathway. The 5' end of the coding sequence of the nucleic acid sequence may inherently contain a signal peptide coding region naturally linked in translation reading frame with the segment of the coding region that encodes the secreted polypeptide. Alternatively, the 5' end of the coding sequence may contain a signal peptide coding region that is foreign to the coding sequence. Any signal peptide coding region that directs the expressed polypeptide into the secretory pathway of a host cell of choice finds use for expression of the engineered TdT polypeptides provided herein. Effective signal peptide coding regions for bacterial host cells include, but are not limited to the signal peptide coding regions obtained from the genes for *Bacillus* NC1B 11837 maltogenic amylase, *Bacillus stearothermophilus* alpha-amylase, *Bacillus licheniformis* subtilisin, *Bacillus licheniformis* beta-lactamase, *Bacillus stearothermophilus* neutral proteases (nprT, nprS, nprM), and *Bacillus subtilis* prsA. Further signal peptides are known in the art (See e.g., Simonen and Palva, Microbiol. Rev., 57:109-137 [1993]). Effective signal peptide coding regions for filamentous fungal host cells include, but are not limited to the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase. Useful signal peptides for yeast host cells include, but are not limited to those from the genes for *Saccharomyces cerevisiae* alpha-factor and *Saccharomyces cerevisiae* invertase.

In some embodiments, the control sequence is a propeptide coding region that codes for an amino acid sequence positioned at the amino terminus of a polypeptide. The resultant polypeptide is referred to as a "proenzyme," "propolypeptide," or "zymogen," in some cases). A propolypeptide can be converted to a mature active polypeptide by catalytic or autocatalytic cleavage of the propeptide from the propolypeptide. The propeptide coding region includes, but is not limited to the genes for *Bacillus subtilis* alkaline protease (aprE), *Bacillus subtilis* neutral protease (nprT), *Saccharomyces cerevisiae* alpha-factor, *Rhizomucor miehei* aspartic proteinase, and *Myceliophthora thermophila* lactase (See e.g., WO 95/33836). Where both signal peptide and propeptide regions are present at the amino terminus of a polypeptide, the propeptide region is positioned next to the amino terminus of a polypeptide and the signal peptide region is positioned next to the amino terminus of the propeptide region.

In some embodiments, regulatory sequences are also utilized. These sequences facilitate the regulation of the expression of the polypeptide relative to the growth of the host cell. Examples of regulatory systems are those which cause the expression of the gene to be turned on or off in response to a chemical or physical stimulus, including the presence of a regulatory compound. In prokaryotic host cells, suitable regulatory sequences include, but are not limited to the lac, tac, and trp operator systems. In yeast host cells, suitable regulatory systems include, but are not limited to the ADH2 system or GAL1 system. In filamentous fungi, suitable regulatory sequences include, but are not limited to the TAKA alpha-amylase promoter, *Aspergillus niger* glucoamylase promoter, and *Aspergillus oryzae* glucoamylase promoter.

The present invention also provides recombinant expression vectors comprising a polynucleotide encoding an engineered TdT polypeptide, and one or more expression regulating regions such as a promoter and a terminator, a replication origin, etc., depending on the type of hosts into which they are to be introduced. In some embodiments, the various nucleic acid and control sequences described above are combined together to produce a recombinant expression vector which includes one or more convenient restriction sites to allow for insertion or substitution of the nucleic acid sequence encoding the variant TdT polypeptide at such sites. Alternatively, the polynucleotide sequence(s) of the present invention are expressed by inserting the polynucleotide sequence or a nucleic acid construct comprising the polynucleotide sequence into an appropriate vector for expression. In creating the expression vector, the coding sequence is located in the vector so that the coding sequence is operably linked with the appropriate control sequences for expression.

The recombinant expression vector may be any vector (e.g., a plasmid or virus), that can be conveniently subjected to recombinant DNA procedures and can result in the expression of the variant TdT polynucleotide sequence. The choice of the vector will typically depend on the compatibility of the vector with the host cell into which the vector is to be introduced. The vectors may be linear or closed circular plasmids.

In some embodiments, the expression vector is an autonomously replicating vector (i.e., a vector that exists as an extra-chromosomal entity, the replication of which is independent of chromosomal replication, such as a plasmid, an extra-chromosomal element, a minichromosome, or an artificial chromosome). The vector may contain any means for assuring self-replication. In some alternative embodiments, the vector may be one which, when introduced into the host cell, is integrated into the genome and replicated together with the chromosome(s) into which it has been integrated. Furthermore, a single vector or plasmid or two or more vectors or plasmids which together contain the total DNA to be introduced into the genome of the host cell, or a transposon may be used.

In some embodiments, the expression vector preferably contains one or more selectable markers, which permit easy selection of transformed cells. A "selectable marker" is a gene the product of which provides for biocide or viral resistance, resistance to heavy metals, prototrophy to auxotrophy, and the like. Examples of bacterial selectable markers include, but are not limited to the dal genes from *Bacillus subtilis* or *Bacillus* lichenformis, or markers, which confer antibiotic resistance such as ampicillin, kanamycin, chloramphenicol or tetracycline resistance. Suitable markers for yeast host cells include, but are not limited to ADE2, HIS3, LEU2, LYS2, MET3, TRP1, and URA3. Selectable markers for use in a filamentous fungal host cell include, but are not limited to, amdS (acetamidase), argB (ornithine carbamoyltransferases), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. In another aspect, the present invention provides a host cell comprising a polynucleotide encoding at least one engineered TdT polypeptide of the present invention, the polynucleotide being operatively linked to one or more control sequences for expression of the engineered TdT enzyme(s) in the host cell. Host cells for use in expressing the polypeptides encoded by the expression vectors of the present invention are well known in the art and include but are not limited to, bacterial cells, such as *E. coli, Vibrio fluvialis, Streptomyces* and *Salmonella typhimurium* cells; fungal cells, such as yeast cells (e.g., *Saccharomyces cerevisiae* and *Pichia pastoris* [ATCC Accession No. 201178]); insect cells such as *Drosophila* S2 and *Spodoptera* Sf9 cells; animal cells such as CHO, COS, BHK, 293, and Bowes melanoma cells; and plant cells. Exemplary host cells are *Escherichia coli* strains (e.g., W3110 (ΔfhuA) and BL21).

In some embodiments, the host cell strain comprises a knockout of one or more genes, in particular phosphatase genes. In some embodiments, the host cell comprises a knockout or single gene deletion of *E. coli* genes aphA, surE, phoA, and/or cpdB, as described below in the Examples. In some embodiments, the host cell comprising a knockout of one or more phosphatase genes has increased production of the product and/or decreased de-phosphorylation of the product or substrate.

Accordingly, in another aspect, the present invention provides methods for producing the engineered TdT polypeptides, where the methods comprise culturing a host cell capable of expressing a polynucleotide encoding the engineered TdT polypeptide under conditions suitable for expression of the polypeptide. In some embodiments, the methods further comprise the steps of isolating and/or purifying the TdT polypeptides, as described herein.

Appropriate culture media and growth conditions for the above-described host cells are well known in the art. Polynucleotides for expression of the TdT polypeptides may be introduced into cells by various methods known in the art. Techniques include, among others, electroporation, biolistic particle bombardment, liposome mediated transfection, calcium chloride transfection, and protoplast fusion.

The engineered TdTs with the properties disclosed herein can be obtained by subjecting the polynucleotide encoding the naturally occurring or engineered TdT polypeptide to mutagenesis and/or directed evolution methods known in the art, and as described herein. An exemplary directed evolution technique is mutagenesis and/or DNA shuffling (See e.g., Stemmer, Proc. Natl. Acad. Sci. USA 91:10747-10751 [1994]; WO 95/22625; WO 97/0078; WO 97/35966; WO 98/27230; WO 00/42651; WO 01/75767 and U.S. Pat. No. 6,537,746). Other directed evolution procedures that can be used include, among others, staggered extension process (StEP), in vitro recombination (See e.g., Zhao et al., Nat. Biotechnol., 16:258-261 [1998]), mutagenic PCR (See e.g., Caldwell et al., PCR Methods Appl., 3:S136-S140 [1994]), and cassette mutagenesis (See e.g., Black et al., Proc. Natl. Acad. Sci. USA 93:3525-3529 [1996]).

For example, mutagenesis and directed evolution methods can be readily applied to polynucleotides to generate variant libraries that can be expressed, screened, and assayed. Mutagenesis and directed evolution methods are well known in the art (See e.g., U.S. Pat. Nos. 5,605,793, 5,811,238, 5,830,721, 5,834,252, 5,837,458, 5,928,905, 6,096,548, 6,117,679, 6,132,970, 6,165,793, 6,180,406, 6,251,674, 6,265,201, 6,277,638, 6,287,861, 6,287,862, 6,291,242, 6,297,053, 6,303,344, 6,309,883, 6,319,713, 6,319,714, 6,323,030, 6,326,204, 6,335,160, 6,335,198, 6,344,356, 6,352,859, 6,355,484, 6,358,740, 6,358,742, 6,365,377, 6,365,408, 6,368,861, 6,372,497, 6,337,186, 6,376,246, 6,379,964, 6,387,702, 6,391,552, 6,391,640, 6,395,547, 6,406,855, 6,406,910, 6,413,745, 6,413,774, 6,420,175, 6,423,542, 6,426,224, 6,436,675, 6,444,468, 6,455,253, 6,479,652, 6,482,647, 6,483,011, 6,484,105, 6,489,146, 6,500,617, 6,500,639, 6,506,602, 6,506,603, 6,518,065, 6,519,065, 6,521,453, 6,528,311, 6,537,746, 6,573,098, 6,576,467, 6,579,678, 6,586,182, 6,602,986, 6,605,430, 6,613,514, 6,653,072, 6,686,515, 6,703,240, 6,716,631, 6,825,001, 6,902,922, 6,917,882, 6,946,296, 6,961,664, 6,995,017, 7,024,312, 7,058,515, 7,105,297, 7,148,054, 7,220,566, 7,288,375, 7,384,387, 7,421,347, 7,430,477, 7,462,469, 7,534,564, 7,620,500, 7,620,502, 7,629,170, 7,702,464, 7,747,391, 7,747,393, 7,751,986, 7,776,598, 7,783,428, 7,795,030, 7,853,410, 7,868,138, 7,783,428, 7,873,477, 7,873,499, 7,904,249, 7,957,912, 7,981,614, 8,014,961, 8,029,988, 8,048,674, 8,058,001, 8,076,138, 8,108,150, 8,170,806, 8,224,580, 8,377,681, 8,383,346, 8,457,903, 8,504,498, 8,589,085, 8,762,066, 8,768,871, 9,593,326, and all related US, as well as PCT and non-US counterparts; Ling et al., Anal. Biochem., 254(2):157-78 [1997]; Dale et al., Meth. Mol. Biol., 57:369-74 [1996]; Smith, Ann. Rev. Genet., 19:423-462 [1985]; Botstein et al., Science, 229:1193-1201 [1985]; Carter, Biochem. J., 237: 1-7 [1986]; Kramer et al., Cell, 38:879-887 [1984]; Wells et al., Gene, 34:315-323 [1985]; Minshull et al., Curr. Op. Chem. Biol., 3:284-290 [1999]; Christians et al., Nat. Biotechnol., 17:259-264 [1999]; Crameri et al., Nature, 391: 288-291 [1998]; Crameri, et al., Nat. Biotechnol., 15:436-438 [1997]; Zhang et al., Proc. Nat. Acad. Sci. U.S.A., 94:4504-4509 [1997]; Crameri et al., Nat. Biotechnol., 14:315-319 [1996]; Stemmer, Nature, 370:389-391 [1994]; Stemmer, Proc. Nat. Acad. Sci. USA, 91:10747-10751 [1994]; WO 95/22625; WO 97/0078; WO 97/35966; WO 98/27230; WO 00/42651; WO 01/75767; and WO 2009/152336, all of which are incorporated herein by reference).

In some embodiments, the enzyme clones obtained following mutagenesis treatment are screened by subjecting the enzymes to a defined temperature (or other assay conditions, such as testing the enzyme's activity over a broad range of substrates) and measuring the amount of enzyme activity remaining after heat treatments or other assay conditions. Clones containing a polynucleotide encoding a TdT polypeptide are then sequenced to identify the nucleotide sequence changes (if any), and used to express the enzyme in a host cell. Measuring enzyme activity from the expression libraries can be performed using any suitable method known in the art (e.g., standard biochemistry techniques, such as HPLC analysis).

In some embodiments, the clones obtained following mutagenesis treatment can be screened for engineered TdTs having one or more desired improved enzyme properties (e.g., improved regioselectivity). Measuring enzyme activity from the expression libraries can be performed using the standard biochemistry techniques, such as HPLC analysis, LC-MS analysis, RapidFire-MS analysis, and/or capillary electrophoresis analysis.

When the sequence of the engineered polypeptide is known, the polynucleotides encoding the enzyme can be prepared by standard solid-phase methods, according to known synthetic methods. In some embodiments, fragments of up to about 100 bases can be individually synthesized, then joined (e.g., by enzymatic or chemical ligation methods, or polymerase mediated methods) to form any desired continuous sequence. For example, polynucleotides and oligonucleotides encoding portions of the TdT can be prepared by chemical synthesis as known in the art (e.g., the classical phosphoramidite method of Beaucage et al., Tet. Lett. 22:1859-69 [1981], or the method described by Matthes et al., EMBO J. 3:801-05 [1984]) as typically practiced in automated synthetic methods. According to the phosphoramidite method, oligonucleotides are synthesized (e.g., in an automatic DNA synthesizer), purified, annealed, ligated and cloned in appropriate vectors. In addition, essentially any nucleic acid can be obtained from any of a variety of commercial sources. In some embodiments, additional variations can be created by synthesizing oligonucleotides containing deletions, insertions, and/or substitutions, and combining the oligonucleotides in various permutations to create engineered TdTs with improved properties.

Accordingly, in some embodiments, a method for preparing the engineered TdT polypeptide comprises: (a) synthesizing a polynucleotide encoding a polypeptide comprising an amino acid sequence having at least about 60%, 70%, 80%, 85%, 86%, 87%, 88%, 89%, 90%, 91%, 92%, 93%, 94%, 95%, 96%, 97%, 98%, or 99% or more sequence identity to an amino acid sequence selected from the even-numbered sequences of SEQ ID NOs: 4-3592 and 3698-6766, and having one or more residue differences or residue difference sets as compared to SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636; and (b) expressing the TdT polypeptide encoded by the polynucleotide.

In some embodiments of the method, the polynucleotide encodes an engineered TdT that has optionally one or several (e.g., up to 3, 4, 5, or up to 10) amino acid residue deletions, insertions and/or substitutions. In some embodiments, the amino acid sequence has optionally 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, 1-50, 1-75, 1-100, or 1-150 amino acid residue deletions, insertions and/or substitutions. In some embodiments, the amino acid sequence has optionally around 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, 50, 55, 60, 65, 70, 80, 90, 100, 110, 120, 130, 140, or 150 amino acid residue deletions, insertions and/or substitutions. In some embodiments, the substitutions can be conservative or non-conservative substitutions.

In some embodiments, any of the engineered TdT enzymes expressed in a host cell can be recovered from the cells and/or the culture medium using any one or more of the well-known techniques for protein purification, including, among others, lysozyme treatment, sonication, filtration, salting-out, ultra-centrifugation, and chromatography. Suitable solutions for lysing and the high efficiency extraction of proteins from bacteria, such as *E. coli*, are commercially available (e.g., CelLytic B™, Sigma-Aldrich, St. Louis MO).

Chromatographic techniques for isolation of the TdT polypeptide include, among others, reverse phase chromatography high performance liquid chromatography, ion exchange chromatography, gel electrophoresis, and affinity chromatography. Conditions for purifying a particular enzyme will depend, in part, on factors such as net charge, hydrophobicity, hydrophilicity, molecular weight, molecular shape, etc., and will be apparent to those having skill in the art.

In some embodiments, affinity techniques may be used to isolate the improved TdT enzymes. For affinity chromatography purification, any antibody which specifically binds the TdT polypeptide may be used. For the production of antibodies, various host animals, including but not limited to rabbits, mice, rats, etc., may be immunized by injection with a TdT polypeptide, or a fragment thereof. The TdT polypeptide or fragment may be attached to a suitable carrier, such as BSA, by means of a side chain functional group or linkers attached to a side chain functional group. In some embodiments, the affinity purification can use a specific ligand bound by the TdT or dye affinity column (See e.g., EP0641862; Stellwagen, "Dye Affinity Chromatography," In *Current Protocols in Protein Science*, Unit 9.2-9.2.16 [2001]).

Methods of Using the Engineered TdT Enzymes

In some embodiments, the TdT enzymes described herein find use in processes for conversion of one or more suitable substrates to a product.

In some embodiments, the engineered TdT polypeptides disclosed herein can be used in a process for the conversion of the oligo acceptor substrate and an NTP-3'-O-RBG substrate to a product comprising an oligo acceptor substrate extended by one nucleotide.

In the embodiments provided herein and illustrated in the Examples, various ranges of suitable reaction conditions that can be used in the processes, include but are not limited to, substrate loading, co-substrate loading, pH, temperature, buffer, solvent system, cofactor, polypeptide loading, and reaction time. Further suitable reaction conditions for carrying out the process for biocatalytic conversion of substrate compounds to product compounds using an engineered TdT described herein can be readily optimized in view of the guidance provided herein by routine experimentation that includes, but is not limited to, contacting the engineered TdT polypeptide and one or more substrate compounds under experimental reaction conditions of concentration, pH, temperature, and solvent conditions, and detecting the product compound.

The oligo acceptor substrate may be any nucleotide chain or similar moiety with an exposed 3'-OH. In some embodiments, the acceptor substrate may be single stranded. In yet other embodiments, the acceptor substrate may be double stranded or partially doubled stranded. In some embodiments, the acceptor substrate may comprise a nucleotide chain consisting of 1-10 NTPs, 5-20 NTPs, 15-50 NTPs, 30-100 NTPs or greater than 100 NTPs. In some embodiments, the acceptor substrate may comprise a chemical moiety that is not a nucleotide chain but contains a free —OH capable of being recognized as a substrate by a wild-type or engineered TdT.

In some embodiments, the oligo acceptor substrate comprises a nucleotide chain of repeating NTPs. In other embodiments, the oligo acceptor substrate comprises a nucleotide chain of varied NTPs that do not repeat. In some embodiments, the oligo acceptor substrate comprises a nucleotide chain with an odd number of NTPs. In some embodiments, the oligo acceptor substrate comprises a nucleotide with an even number of NTPs.

In some embodiments, the oligo acceptor substate is secured to solid support. Suitable solid supports are known to those in the art and described, above, in this disclosure.

In some embodiments, the oligo acceptor substrate comprises the nucleotide sequence TAATT. In some embodiments, the oligo acceptor substrate comprises the nucleotide sequence TAATC. In yet other embodiments, the oligo acceptor substrate comprises the nucleotide sequence TTTTTTTATC. In some embodiments, the oligo acceptor substrate comprises the nucleotide sequence TTTTTT-TATG. In some embodiments, the oligo acceptor substrate comprises the nucleotide sequence TTTTTTTACA. In some embodiments, the oligo acceptor substrate comprises the nucleotide sequence TTTTTTTCCG. In some embodiments, the oligo acceptor substrate comprises the nucleotide sequence TTTTTTTCTG. In other embodiments, the oligo acceptor substrate comprises the nucleotide sequence TTTTTTTCGA. In yet further embodiments, the acceptor substrate comprises the nucleotide sequence TTTTTTTCGG. These embodiments are intended to be non-limiting. Any suitable oligo acceptor substrate finds use in the present invention.

In some embodiments, the NTP-3'-O-RBG substrate comprises a deoxyribonucleoside triphosphate with a 3'-O-RBG. In other embodiments, the NTP-3'-O-RBG substrate may comprise a ribonucleoside triphosphate with a 3'-O-RBG. In yet other embodiments, the NTP-3'-O-RBG substrate may comprise a synthetic nucleoside triphosphate with a 3'-O-RBG. In some embodiments, the NTP-3'-O-RBG substrate may comprise a sugar ring with a number of carbons that is not five. A non-limiting example of this is a threose nucleoside triphosphate.

In some embodiments, the NTP-3'-O-RBG substrate may comprise a removable blocking group selected from the group consisting of NTP-3'-O—$NH_2$, NTP-3'-O—$NO_2$, or NTP-3'-O—$PO_3$. In some embodiments, the NTP-3'-O-RBG substrate comprises another blocking group that would sterically hinder addition of a second NTP-3'-O-RBG substrate to the 3' end of the growing oligo acceptor substrate strand prior to removal of the removable blocking from the first round of addition.

In some embodiments, the deoxyribonucleoside triphosphate with a 3'-O-RBG or ribonucleoside triphosphate with a 3'-O-RBG may have a natural purine or pyrimidine base, such as adenine, guanine, cytosine, thymine, or uridine. In some embodiments, deoxyribonucleoside triphosphate with a 3'-O-RBG or ribonucleoside triphosphate with a 3'-O-RBG may have an unnatural base analog such as inosine, xanthine, hypoxanthine or another base analog, as is known in the art. In some embodiments, deoxyribonucleoside triphosphate with a 3'-O-RBG or ribonucleoside triphosphate with a 3'-O-RBG may have base with modifications, as is known in the art.

The substrate compound(s) in the reaction mixtures can be varied, taking into consideration, for example, the desired amount of product compound, the effect of each substrate concentration on enzyme activity, stability of enzyme under reaction conditions, and the percent conversion of each substrate to product. In some embodiments, the suitable reaction conditions comprise a substrate compound loading for each oligo acceptor substrate of at least about 0.1 uM to 1 uM, 1 uM to 2 uM, 2 uM to 3 uM, 3 uM to 5 uM, 5 uM to 10 uM, or 10 uM or greater. In some embodiments, the suitable reaction conditions comprise a substrate compound loading for each oligo acceptor substrate of at least about 0.5 to about 25 g/L, 1 to about 25 g/L, 5 to about 25 g/L, about 10 to about 25 g/L, or 20 to about 25 g/L. In some embodiments, the suitable reaction conditions comprise a substrate compound loading for each oligo acceptor substrate of at least about 0.5 g/L, at least about 1 g/L, at least about 5 g/L, at least about 10 g/L, at least about 15 g/L, at least about 20 g/L, or at least about 30 g/L, or even greater.

In some embodiments, the suitable reaction conditions comprise a substrate compound loading for each NTP-3'-O-RBG of at least about 1 uM to 5 uM, 5 uM to 10 uM, 10 uM to 25 uM, 25 uM to 50 uM, 50 uM to 100 uM, 100 uM to 200 uM, 200 uM to 300 uM, or 300 uM to 500 uM. In some embodiments, the suitable reaction conditions comprise a substrate compound loading for each oligo acceptor substrate of at least about 0.5 g/L, at least about 1 g/L, at least about 5 g/L, at least about 10 g/L, at least about 15 g/L, at least about 20 g/L, or at least about 30 g/L, or even greater.

In carrying out the TdT-mediated synthesis processes described herein, the engineered polypeptide may be added to the reaction mixture in the form of a purified enzyme, partially purified enzyme, whole cells transformed with gene(s) encoding the enzyme, as cell extracts and/or lysates of such cells, and/or as an enzyme immobilized on a solid support. Whole cells transformed with gene(s) encoding the engineered TdT enzyme or cell extracts, lysates thereof, and isolated enzymes may be employed in a variety of different forms, including solid (e.g., lyophilized, spray-dried, and the like) or semisolid (e.g., a crude paste). The cell extracts or cell lysates may be partially purified by precipitation (ammonium sulfate, polyethyleneimine, heat treatment or the like, followed by a desalting procedure prior to lyophilization (e.g., ultrafiltration, dialysis, etc.). Any of the enzyme preparations (including whole cell preparations) may be stabilized by crosslinking using known crosslinking agents, such as, for example, glutaraldehyde or immobilization to a solid phase (e.g., Eupergit C, and the like).

The gene(s) encoding the engineered TdT polypeptides can be transformed into host cell separately or together into the same host cell. For example, in some embodiments one set of host cells can be transformed with gene(s) encoding one engineered TdT polypeptide and another set can be transformed with gene(s) encoding another TdT. Both sets of transformed cells can be utilized together in the reaction mixture in the form of whole cells, or in the form of lysates or extracts derived therefrom. In other embodiments, a host cell can be transformed with gene(s) encoding multiple engineered TdT polypeptides. In some embodiments the engineered polypeptides can be expressed in the form of secreted polypeptides and the culture medium containing the secreted polypeptides can be used for the TdT reaction.

In some embodiments, the improved activity of the engineered TdT polypeptides disclosed herein provides for processes wherein higher percentage conversion can be achieved with lower concentrations of the engineered polypeptide. In some embodiments of the process, the suitable reaction conditions comprise an engineered polypeptide amount of about 1% (w/w), 2% (w/w), 5% (w/w), 10% (w/w), 20% (w/w), 30% (w/w), 40% (w/w), 50% (w/w), 75% (w/w), 100% (w/w) or more of substrate compound loading.

In some embodiments, the engineered polypeptide is present at a molar ratio of engineered polypeptide to substrate of about 50 to 1, 25 to 1, 10 to 1, 5 to 1, 1 to 1, 1 to 5, 1 to 10, 1 to 25 or 1 to 50. In some embodiments, the engineered polypeptide is present at a molar ratio of engineered polypeptide to substrate from a range of about 50 to 1 to a range of about 1 to 50.

In some embodiments, the engineered polypeptide is present at about 0.01 g/L to about 50 g/L; about 0.01 to about 0.1 g/L; about 0.05 g/L to about 50 g/L; about 0.1 g/L to about 40 g/L; about 1 g/L to about 40 g/L; about 2 g/L to about 40 g/L; about 5 g/L to about 40 g/L; about 5 g/L to about 30 g/L; about 0.1 g/L to about 10 g/L; about 0.5 g/L to about 10 g/L; about 1 g/L to about 10 g/L; about 0.1 g/L to about 5 g/L; about 0.5 g/L to about 5 g/L; or about 0.1 g/L to about 2 g/L. In some embodiments, the TdT polypeptide is present at about 0.01 g/L, 0.05 g/L, 0.1 g/L, 0.2 g/L, 0.5 g/L, 1, 2 g/L, 5 g/L, 10 g/L, 15 g/L, 20 g/L, 25 g/L, 30 g/L, 35 g/L, 40 g/L, or 50 g/L.

In some embodiments, the suitable reaction conditions comprise a divalent metal cofactor. In some embodiments, the divalent metal cofactor is cobalt. In some embodiments, the cobalt is present in the reaction mixture as cobalt (II) chloride. In some embodiments, the cobalt (II) chloride is present at concentrations of about 1 to 500 uM; about 50 to 400 uM; about 100 to 300 uM; or about 200 to 300 uM. In some embodiments, the cobalt (II) chloride is present at concentrations of about 150 uM; about 200 uM; about 250 uM, or about 300 uM.

In some embodiments, the suitable reaction conditions comprise potassium acetate. In some embodiments, the potassium acetate is present at concentrations of 1 to 100 mM; 25 to 75 mM; or 30 to 60 mM. In some embodiments, the potassium acetate is present at concentrations of about 25 mM; about 50 mM; or about 75 mM.

In some embodiments of the reaction, a phosphatase is used to degrade inorganic phosphate and shift the reaction equilibrium toward the oligo acceptor extension product. In some embodiments, the phosphatase is an *E. coli* pyrophosphatase. In some embodiments, the phosphatase is present at a concentration of about 0.0001 to 0.01 units/uL; about 0.001 to 0.005 units/uL; or about 0.002 to 0.003 units/uL. In some embodiments, the phosphatase is present at a concentration of about 0.001 units/uL; about 0.002 units/uL; or about 0.003 units/uL.

During the course of the reaction, the pH of the reaction mixture may change. The pH of the reaction mixture may be maintained at a desired pH or within a desired pH range. This may be done by the addition of an acid or a base, before and/or during the course of the reaction. Alternatively, the pH may be controlled by using a buffer. Accordingly, in some embodiments, the reaction condition comprises a buffer. Suitable buffers to maintain desired pH ranges are known in the art and include, by way of example and not limitation, borate, phosphate, 2-(N-morpholino)ethanesulfonic acid (MES), 3-(N-morpholino)propanesulfonic acid (MOPS), acetate, triethanolamine, and 2-amino-2-hydroxymethyl-propane-1,3-diol (Tris), and the like. In some embodiments, the reaction conditions comprise water as a suitable solvent with no buffer present.

In the embodiments of the process, the reaction conditions comprise a suitable pH. The desired pH or desired pH range can be maintained by use of an acid or base, an appropriate buffer, or a combination of buffering and acid or base addition. The pH of the reaction mixture can be controlled before and/or during the course of the reaction. In some embodiments, the suitable reaction conditions comprise a solution pH from about 4 to about 10, pH from about 5 to about 10, pH from about 5 to about 9, pH from about 6 to about 9, pH from about 6 to about 8. In some embodiments, the reaction conditions comprise a solution pH of about 4, 4.5, 5, 5.5, 6, 6.5, 7, 7.5, 8, 8.5, 9, 9.5, or 10.

In the embodiments of the processes herein, a suitable temperature is used for the reaction conditions, for example, taking into consideration the increase in reaction rate at higher temperatures, and the activity of the enzyme during the reaction time period. Accordingly, in some embodiments, the suitable reaction conditions comprise a temperature of about 10° C. to about 95° C., about 10° C. to about 75° C., about 15° C. to about 95° C., about 20° C. to about 95° C., about 20° C. to about 65° C., about 25° C. to about 70° C., or about 50° C. to about 70° C. In some embodiments, the suitable reaction conditions comprise a temperature of about 10° C., 15° C., 20° C., 25° C., 30° C., 35° C., 40° C., 45° C., 50° C., 55° C., 60° C., 65° C., 70° C., 75° C., 80° C., 85° C., 90° C. or 95° C. In some embodiments, the temperature during the enzymatic reaction can be maintained at a specific temperature throughout the course of the reaction. In some embodiments, the temperature during the enzymatic reaction can be adjusted over a temperature profile during the course of the reaction.

In some embodiments, the processes of the invention are carried out in a solvent. Suitable solvents include water, aqueous buffer solutions, organic solvents, polymeric solvents, and/or co-solvent systems, which generally comprise aqueous solvents, organic solvents and/or polymeric solvents. The aqueous solvent (water or aqueous co-solvent system) may be pH-buffered or unbuffered. In some embodiments, the processes using the engineered TdT polypeptides can be carried out in an aqueous co-solvent system comprising an organic solvent (e.g., ethanol, isopropanol (IPA), dimethyl sulfoxide (DMSO), dimethylformamide (DMF) ethyl acetate, butyl acetate, 1-octanol, heptane, octane, methyl t butyl ether (MTBE), toluene, and the like), ionic or polar solvents (e.g., 1-ethyl 4 methylimidazolium tetrafluoroborate, 1-butyl-3-methylimidazolium tetrafluoroborate, 1-butyl 3 methylimidazolium hexafluorophosphate, glycerol, polyethylene glycol, and the like). In some embodiments, the co-solvent can be a polar solvent, such as a polyol, dimethylsulfoxide (DMSO), or lower alcohol. The non-aqueous co-solvent component of an aqueous co-solvent system may be miscible with the aqueous component, providing a single liquid phase, or may be partly miscible or immiscible with the aqueous component, providing two liquid phases. Exemplary aqueous co-solvent systems can comprise water and one or more co-solvents selected from an organic solvent, polar solvent, and polyol solvent. In general, the co-solvent component of an aqueous co-solvent system is chosen such that it does not adversely inactivate the TdT enzyme under the reaction conditions. Appropriate co-solvent systems can be readily identified by measuring the enzymatic activity of the specified engineered TdT enzyme with a defined substrate of interest in the candidate solvent system, utilizing an enzyme activity assay, such as those described herein.

In some embodiments of the process, the suitable reaction conditions comprise an aqueous co-solvent, where the co-solvent comprises DMSO at about 1% to about 50% (v/v), about 1 to about 40% (v/v), about 2% to about 40% (v/v), about 5% to about 30% (v/v), about 10% to about 30% (v/v), or about 10% to about 20% (v/v). In some embodiments of the process, the suitable reaction conditions can comprise an aqueous co-solvent comprising ethanol at about 1% (v/v), about 5% (v/v), about 10% (v/v), about 15% (v/v), about 20% (v/v), about 25% (v/v), about 30% (v/v), about 35% (v/v), about 40% (v/v), about 45% (v/v), or about 50% (v/v).

In some embodiments, the reaction conditions comprise a surfactant for stabilizing or enhancing the reaction. Surfactants can comprise non-ionic, cationic, anionic and/or amphiphilic surfactants. Exemplary surfactants, include by way of example and not limitation, nonyl phenoxypolyethoxylethanol (NP40), TRITON™ X-100 (polyethylene glycol tert-octylphenyl ether), polyoxyethylene-stearylamine, cetyltrimethylammonium bromide, sodium oleylamidosulfate, polyoxyethylene-sorbitanmonostearate, hexadecyldimethylamine, etc. Any surfactant that may stabilize or enhance the reaction may be employed. The concentration of the surfactant to be employed in the reaction may be generally from 0.1 to 50 mg/ml, particularly from 1 to 20 mg/ml.

In some embodiments, the reaction conditions include an antifoam agent, which aids in reducing or preventing formation of foam in the reaction solution, such as when the reaction solutions are mixed or sparged. Anti-foam agents include non-polar oils (e.g., minerals, silicones, etc.), polar oils (e.g., fatty acids, alkyl amines, alkyl amides, alkyl sulfates, etc.), and hydrophobic (e.g., treated silica, polypropylene, etc.), some of which also function as surfactants. Exemplary anti-foam agents include Y-30® (Dow Corning), poly-glycol copolymers, oxy/ethoxylated alcohols, and polydimethylsiloxanes. In some embodiments, the anti-foam can be present at about 0.001% (v/v) to about 5% (v/v), about 0.01% (v/v) to about 5% (v/v), about 0.1% (v/v) to about 5% (v/v), or about 0.1% (v/v) to about 2% (v/v). In some embodiments, the anti-foam agent can be present at about 0.001% (v/v), about 0.01% (v/v), about 0.1% (v/v), about 0.5% (v/v), about 1% (v/v), about 2% (v/v), about 3% (v/v), about 4% (v/v), or about 5% (v/v) or more as desirable to promote the reaction.

The quantities of reactants used in the TdT reaction will generally vary depending on the quantities of product desired, and concomitantly the amount of substrates employed. Those having ordinary skill in the art will readily understand how to vary these quantities to tailor them to the desired level of productivity and scale of production.

In some embodiments, the order of addition of reactants is not critical. The reactants may be added together at the same time to a solvent (e.g., monophasic solvent, biphasic aqueous co-solvent system, and the like), or alternatively, some of the reactants may be added separately, and some together at different time points. For example, the cofactor, co-substrate and substrate may be added first to the solvent.

The solid reactants (e.g., enzyme, salts, etc.) may be provided to the reaction in a variety of different forms, including powder (e.g., lyophilized, spray dried, and the like), solution, emulsion, suspension, and the like. The reactants can be readily lyophilized or spray dried using methods and equipment that are known to those having ordinary skill in the art. For example, the protein solution can be frozen at −80° C. in small aliquots, then added to a pre-chilled lyophilization chamber, followed by the application of a vacuum.

For improved mixing efficiency when an aqueous co-solvent system is used, the TdT, and co-substrate may be added and mixed into the aqueous phase first. The substrate may be added and mixed in, followed by the organic phase or the substrate may be dissolved in the organic phase and mixed in. Alternatively, the substrate may be premixed in the organic phase, prior to addition to the aqueous phase.

The processes of the present invention are generally allowed to proceed until further conversion of substrate to product does not change significantly with reaction time (e.g., less than 10% of substrate being converted, or less than 5% of substrate being converted). In some embodiments, the reaction is allowed to proceed until there is complete or near complete conversion of substrate to product. Transformation of substrate to product can be monitored using known methods by detecting substrate and/or product, with or without derivatization. Suitable analytical methods include gas chromatography, HPLC, MS, and the like. In some embodiments, after suitable conversion to product, the reactants are separated from the oligo acceptor substrate extension product and additional reactants are added to the oligo acceptor substrate extension product to further extend the growing polynucleotide chain. The processes of the present invention may be used to iteratively extend the oligo acceptor extension product until a polynucleotide of a defined sequence and length is synthesized.

Any of the processes disclosed herein using the engineered polypeptides for the preparation of products can be carried out under a range of suitable reaction conditions, including but not limited to ranges of substrates, temperature, pH, solvent system, substrate loading, polypeptide loading, cofactor loading, and reaction time. In one example, the suitable reaction conditions comprise: (a) oligo acceptor substrate loading of about 0.1-20 uM of substrate compound; (b) NTP-3'-O-RBG substrate loading of about 1-1000 uM of substrate compound; (c) of about 0.01 g/L to 5 g/L engineered polypeptide; (d) 100 to 400 uM cobalt (II) chloride; (e) 25 to 75 mM potassium acetate; (f) 5 to 100 mM MOPS buffer; (g) 0.0001 to 0.03 units/uL pyrophosphatase; (h) pH at 5-9; and (i) temperature of about 15° C. to 70° C. In some embodiments, the suitable reaction conditions comprise: (a) oligo acceptor substrate loading of about 1 uM of substrate compound; (b) NTP-3'-O-RBG substrate loading of about 50 uM of substrate compound; (c) of about 0.04 g/L engineered polypeptide; (d) 250 uM cobalt (II) chloride; (e) 50 mM potassium acetate; (f) 20 mM MOPS buffer; (g) 0.001 to 0.003 units/uL pyrophosphatase; (h) pH at 7.2; and (i) temperature of about 60° C. In some embodiments, additional reaction components or additional techniques carried out to supplement the reaction conditions. These can include taking measures to stabilize or prevent inactivation of the enzyme, reduce product inhibition, shift reaction equilibrium to formation of the desired product.

In some embodiments, the suitable reaction conditions comprise: (a) 1 μM engineered TdT polypeptide, (b) 1 μM oligo acceptor substrate, (c) 1-10 μM NTP-3'-O-RBG, and (d) 60° C., wherein greater than 99.5% conversion is achieved after 90 seconds. In some embodiments, the present disclosure provides an engineered TdT capable of 99.5% conversion of 1 μM oligo acceptor substrate and 1-10 μM NTP-3'-O-RBG under suitable reaction conditions to form an N+1 extension product at 60° C. after 90 seconds. In some embodiments, the engineered TdT capable of 99.5% conversion of 1 μM oligo acceptor substrate and 1-10 μM NTP-3'-O-RBG under suitable reaction conditions to form an N+1 extension product at 60° C. after 90 seconds is an engineered TdT polypeptide comprising an amino acid sequence having at least 60%, 70%, 80%, 85%, 86%, 87%, 88%, 89%, 90%, 91%, 92%, 93%, 94%, 95%, 96%, 97%, 98%, 99% or more identity to SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636.

In some embodiments, the present disclosure provides an engineered TdT, wherein said engineered TdT has improved activity on NTP-3'-RBGs, such that NTP-3'-RBGs are incorporated with equivalent efficiency to native NTPs, as compared to another wild-type or engineered TdT. In some embodiments, the engineered TdT with improved activity on dNTP-3'-O—$PO_3$, such that dNTP-3'-O—$PO_3$ is incorporated with equivalent efficiency to native dNTPs, is an engineered TdT polypeptide comprising an amino acid sequence having at least 60%, 70%, 80%, 85%, 86%, 87%, 88%, 89%, 90%, 91%, 92%, 93%, 94%, 95%, 96%, 97%, 98%, 99% or more identity to SEQ ID NOs: 2, 4, 580, 692, 882, 914, 1034, 1270, 1344, 1346, 1678, 1700, 1750, 1932, 2164, 2666, 2794, 2978, 3074, 3302, 3398, 3488, 3958, 3788, 4124, 4226, 4734, 5052, 5152, 5252, 5296, 5628, 5630, 5632, and/or 5636.

In further embodiments, any of the above described processes for the conversion of one or more substrate compounds to product compound can further comprise one or more steps selected from: extraction; isolation; purification; and crystallization of product compound. Methods, techniques, and protocols for extracting, isolating, purifying, and/or crystallizing the product from biocatalytic reaction mixtures produced by the above disclosed processes are known to the ordinary artisan and/or accessed through routine experimentation. Additionally, illustrative methods are provided in the Examples below.

Various features and embodiments of the invention are illustrated in the following representative examples, which are intended to be illustrative, and not limiting.

EXPERIMENTAL

The following Examples, including experiments and results achieved, are provided for illustrative purposes only and are not to be construed as limiting the present invention. Indeed, there are various suitable sources for many of the reagents and equipment described below. It is not intended that the present invention be limited to any particular source for any reagent or equipment item.

In the experimental disclosure below, the following abbreviations apply: M (molar); mM (millimolar), uM and μM (micromolar); nM (nanomolar); mol (moles); gm and g (gram); mg (milligrams); ug and μg (micrograms); L and l (liter); ml and mL (milliliter); cm (centimeters); mm (millimeters); um and ul (micrometers); sec. (seconds); min(s) (minute(s)); h(s) and hr(s) (hour(s)); U (units); MW (molecular weight); rpm (rotations per minute); psi and PSI (pounds per square inch); ° C. (degrees Centigrade); RT and rt (room temperature); CV (coefficient of variability); CAM and cam (chloramphenicol); PMBS (polymyxin B sulfate); IPTG (isopropyl β-D-1-thiogalactopyranoside); LB (lysogeny broth); TB (terrific broth); SFP (shake flask powder); CDS (coding sequence); DNA (deoxyribonucleic acid); RNA (ribonucleic acid); nt (nucleotide; polynucleotide); aa (amino acid; polypeptide); *E. coli* W3110 (commonly used laboratory *E. coli* strain, available from the Coli Genetic Stock Center [CGSC], New Haven, CT); HTP (high throughput); HPLC (high pressure liquid chromatography); HPLC-UV (HPLC-Ultraviolet Visible Detector); 1H NMR (proton nuclear magnetic resonance spectroscopy); FIOPC (fold improvements over positive control); Sigma and Sigma-Aldrich (Sigma-Aldrich, St. Louis, MO; Difco (Difco Laboratories, BD Diagnostic Systems, Detroit, MI); Microfluidics (Microfluidics, Westwood, MA); Life Technologies (Life Technologies, a part of Fisher Scientific, Waltham, MA); Amresco (Amresco, LLC, Solon, OH); Carbosynth (Carbosynth, Ltd., Berkshire, UK); Varian (Varian Medical Systems, Palo Alto, CA); Agilent (Agilent Technologies, Inc., Santa Clara, CA); Infors (Infors USA Inc., Annapolis Junction, MD); and Thermotron (Thermotron, Inc., Holland, MI).

Example 1

Terminal Deoxynucleotidyl Transferase (TdT) Gene Acquisition and Construction of Expression Vectors The wild-type (WT) terminal deoxynucleotidyl transferase (TdT) enzyme (SEQ ID NO:2) is a predicted splice variant encoded by the genome of species *Empidonax traillii*. A synthetic gene (SEQ ID NO:3) encoding an N-terminal 6-histidine tagged version of the WT TdT truncated at amino acid position 131 (SEQ ID NO:4) was designed with codon optimization for *E. coli* expression, synthesized, and subcloned into the *E. coli* expression vector pCK100900i (See e.g., U.S. Pat. No. 7,629,157 and US Pat. Appln. Publn. 2016/0244787, both of which are hereby incorporated by reference). This plasmid construct was transformed into an *E. coli* strain derived from W3110. Directed evolution techniques generally known by those skilled in the art were used to generate libraries of gene variants from these plasmids (See e.g., U.S. Pat. No. 8,383,346 and WO 2010/144103, both of which are hereby incorporated by reference). The substitutions in the enzyme variants described herein are indicated with reference to the truncated and N-terminal 6-histidine tagged version of the WT TdT enzyme (i.e., SEQ ID NO:4) or variants thereof, as indicated.

Example 2

TdT Expression and Purification in High Throughput (HTP)

High Throughput (HTP) Growth of TdT Enzyme and Variants

Transformed *E. coli* cells were selected by plating onto LB agar plates containing 1% glucose and 30 μg/ml chloramphenicol. After overnight incubation at 37° C., colonies were placed into the wells of 96-well shallow flat bottom NUNC™ (Thermo-Scientific) plates filled with 180 μl/well LB medium supplemented with 1% glucose and 30 μg/ml chloramphenicol. The cultures were allowed to grow overnight for 18-20 hours in a shaker (200 rpm, 30° C., and 85% relative humidity; Kuhner). Overnight growth samples (20 μL) were transferred into Costar 96-well deep plates filled with 380 μL of Terrific Broth supplemented with 30 μg/ml chloramphenicol. The plates were incubated for 120 minutes in a shaker (250 rpm, 30° C., and 85% relative humidity; Kuhner) until the $OD_{600}$ reached between 0.4-0.8. The cells were then induced with 40 μL of 10 mM IPTG in sterile water and incubated overnight for 18-20 hours in a shaker (250 rpm, 30° C., and 85% relative humidity; Kuhner). The cells were pelleted (4000 rpm×20 min), the supernatants were discarded, and the cells were frozen at −80° C. prior to analysis.

Lysis of HTP Cell Pellets with Lysozyme

For lysis, 300-400 μl lysis buffer (as specified) containing 50 mM Tris buffer, pH 8.0, 0.2 g/L lysozyme, and 0-300 mM NaCl (as specified) were added to the cell pellet in each well. The cells were lysed at room temperature for 2 hours with shaking on a bench top shaker. The plate was then centrifuged for 15 min at 4,000 rpm and 4C. The clear supernatants were then used in biocatalytic reactions to determine their activity levels.

Lysis of HTP Cell Pellets for HTP Purification of TdT from Crude Lysates

Cell pellets were resuspended in 300 μl/well lysis mixture [50 mM Tris buffer, pH 8.0, 75% (v/v) B-Per reagent (Thermo Fisher), 0.2 mg/ml lysozyme, 300 mM NaCl, 10 mM imidazole, and 0.2% (v/v) Triton™ X-100] was added to the cell suspensions. The mixture was agitated for 2 hours at room temperature, pelleted (4000 rpm×20 min), and supernatants were reserved for purification.

TdT was purified from crude *E. coli* extracts by metal-affinity chromatography using HIS-Select® High Capacity (HC) Nickel Coated Plates (Sigma) according to the manufacturer's instructions.

HIS-Select plates were equilibrated with a total of 800 μl of wash buffer (50 mM Tris-HCl, 300 mM NaCl, 20 mM imidazole, 0.02% v/v Triton™ X-100 reagent) per well. Then, 200 μl of HTP lysate containing TdT loaded onto the plate, and centrifuged for 1 min at 2000 relative centrifugal force (ref) and 4° C. The plate was washed twice with 400 μl of wash buffer/well, with 3 min centrifugations at 3000 ref and 4° C. for each wash. TdT samples were eluted with the addition of 100 μl elution buffer (50 mM Tris-HCl, 300 mM NaCl, 350 mM imidazole, 0.02% v/v Triton™ X-100 reagent) by centrifugation for 1 min @3000 ref at 4° C.

Eluates were buffer-exchanged using Zeba™ Spin desalting plates (Thermo Fisher). Briefly, plates were equilibrated twice with 375 μl of 2×TdT storage buffer (40 mM Tris-HCl pH 7.5, 200 mM KCl, and 0.2 mM EDTA) per well and centrifuged for 2 min @1100×g at 4° C. Desalting plates were loaded with 80 μl of the HIS-Select sample eluate and centrifuged for 2 min @1100×g at 4° C. The eluate from the desalting plate was retained and mixed with an equal volume of glycerol for a final storage buffer concentration of 20 mM Tris-HCl pH 7.5, 100 mM KCl, 0.1 mM EDTA, and 50% glycerol.

Example 3

Shake Flask Expression and Purification of TdT

Shake Flask Expression

Selected HTP cultures grown as described above were plated onto LB agar plates with 1% glucose and 30 μg/ml chloramphenicol and grown overnight at 37° C. A single colony from each culture was transferred to 5 ml of LB broth with 1% glucose and 30 μg/ml chloramphenicol. The cultures were grown for 20 h at 30° C., 250 rpm, and subcultured at a dilution of approximately 1:50 into 250 ml of Terrific Broth with 30 μg/ml of chloramphenicol, to a final $OD_{600}$ of about 0.05. The cultures were incubated for approximately 195 min at 30° C., 250 rpm, to an $OD_{600}$ of about 0.6, and then induced with the addition of IPTG at a final concentration of 1 mM. The induced cultures were incubated for 20 h at 30° C., 250 rpm. Following this incubation period, the cultures were centrifuged at 4000 rpm×10 min. The culture supernatant was discarded, and the pellets were resuspended in 35 ml of 20 mM triethanolamine, pH 7.5. This cell suspension was chilled in an ice bath and lysed using a Microfluidizer cell disruptor (Microfluidics M-110L). The crude lysate was pelleted by centrifugation (11,000 rpm for 60 min at 4° C.), and the supernatant was then filtered through a 0.2 μm PES membrane to further clarify the lysate.

Purification of TdT from Shake Flask Lysates

TdT lysates were supplemented with $1/10^{th}$ volume of SF elution buffer (50 mM Tris-HCl, 500 mM NaCl, 250 mM imidazole, 0.02% v/v Triton™ X-100 reagent) per well. Lysates were then purified using an AKTA Start purification system and a 5 ml HisTrap FF column (GE Healthcare) using the AC Step HiF setting (the run parameters are provided below). The SF wash buffer comprised 50 mM Tris-HCl, 300 mM NaCl, 20 mM imidazole, 0.02% v/v Triton™ X-100 reagent.

TABLE 3.1

Purification Parameters

| Parameter | Volume |
|---|---|
| Column volume | 5 ml |
| Flow rate | 5 ml/min |
| Pressure limit | 0.3 MPa |
| Sample volume | 35 mls |
| Equilibration volume | 5 column volumes (CV) = 25 mls |
| Wash Unbound volume | 15 CV = 75 mls |
| Elution | Isocratic (step) |
| Elution volume | 5 CV = 25 mls |
| Fraction volume | 3 mls |
| RE-equilibration volume | 5 CV = 25 mls |

The single most concentrated 3 ml fraction was identified by UV absorption (A280), and dialyzed overnight in dialysis buffer (20 mM Tris-HCl, pH 7.4, 100 mM KCl, 0.1 mM EDTA, and 50% glycerol) overnight in a 3.5K Slide-A-Lyzer™ dialysis cassette (Thermo Fisher) for buffer exchange. TdT concentrations in the preparations were measured by absorption at 280 nm.

Example 4

HPLC-MS/MS Analysis of Oligonucleotides—Method A (Ultivo)

Reactions were quenched as described in each example. Quenched and clarified reaction supernatant (50 μL) was then transferred to a BioRad PCR plate for LCMS analysis. The samples were analyzed according to the Ultivo analytical method summarized in Table 4.1.

TABLE 4.1

HPLC-MS/MS Analysis of Oligonucleotides—Method A

| | |
|---|---|
| Instrument | Agilent UHPLC 1260 prime series, Agilent Ultivo |
| Column | Phenomenex Clarity Oligo-MS 100A, 50 × 2.1 mm, 2.6 μm with Phenomenex Security Guard cartridge, C18, 2 mm ID |
| Mobile Phases | A: 50 mM TEAA = 50 mM triethylamine, 50 mM acetic acid, in water, B: acetonitrile; needle wash: 80/20 water/acetonitrile. |
| Gradient | Gradient from 98% A to 5% A and back again: |

| Time (min) | % A |
|---|---|
| 0.0 | 98 |
| 0.1 | 98 |
| 1.6 | 5 |
| 2.0 | 5 |
| 2.1 | 98 |
| 4.3 | 98 |

| | |
|---|---|
| Flow rate | 0.6 mL/min |
| Run time | 4.3 min |
| Peak retention times | 1.58 min (analytes co-elute) |
| Column temperature | 50° C. |
| Injection volume | 2 μL |
| MS detection conditions | Ion source: Agilent Jet Stream (AJS) ESI; Scan type: SIM; polarity: negative; dwell time: 50 msec; fragmentor voltage: 180 V; time filter window: 0.02 |
| MS source conditions | Drying gas temperature: 325° C.; drying gas flow: 7.0 L/min; nebulizer pressure: 35 psi; sheath gas temperature: 250° C.; sheath gas flow: 12.0 L/min; capillary voltage: −3500 V; nozzle voltage: −2000 |
| Analyte charge state | $[M-3H]^{3-}$ |

| Product Name | Substrate Name | dNTP | method | what | analyte | m/z value |
|---|---|---|---|---|---|---|
| TAATTddT | TAATT | ddTTP | 1 | substrate | TAATT | 737.1 |
| | | | | product | TAATTddT | 881.2 |
| TAATCA-3'PO4 | TAATC | 3'PO4-dATP | 2 | substrate | TAATC | 729.6 |
| | | | | product | TAATCA-3'PO4 | 926.2 |
| | | | | N + 1 unblocked | TAATCA | 886.2 |
| TAATCT-3'NO2 | TAATC | 3'NO3-dTTP | 3 | substrate | TAATC | 729.6 |
| | | | | product | TAATCT-3'NO2 | 904.2 |
| | | | | N + 1 unblocked | TAATCT | 881.7 |
| Tx7ATCT-3'NO3 | Tx7ATC | 3'NO3-dTTP | 4 | substrate | Tx7ATC | 989.8 |
| | | | | product | Tx7ATCT-3'NO2 | 1106.2 |
| | | | | N + 1 unblocked | Tx7ATCT | 1091.2 |
| Tx7ATCC-3'PO4 | Tx7ATC | 3'PO4-dCTP | 5 | substrate | Tx7ATC | 989.8 |
| | | | | product | Tx7ATCC-3'PO4 | 1112.8 |
| | | | | N + 1 unblocked | Tx7ATCC | 1086.5 |
| Tx7ATCT-3'PO4 | Tx7ATC | 3'PO4-dTTP | 6 | substrate | Tx7ATC | 990.1 |
| | | | | product | Tx7ATCT-3'PO4 | 1118.1 |
| | | | | N + 1 unblocked | Tx7ATCT | 1091.2 |
| Tx7ATGC-3'PO4 | Tx7ATG | 3'PO4-dCTP | 7 | substrate | Tx7ATG | 1003.2 |
| | | | | product | Tx7ATGC-3'PO4 | 1126.2 |
| | | | | N + 1 unblocked | Tx7ATGC | 1099.5 |
| Tx7ATCG-3'PO4 | Tx7ATC | 3'PO4-dGTP | 8 | | | |
| | | | | product | Tx7ATCG-3'PO4 | 1126.2 |
| | | | | N + 1 unblocked | Tx7ATCG | 1099.5 |
| Tx7ACAC-3'PO4 | Tx7ACA | 3'PO4-dCTP | 9 | substrate | Tx7ACA | 993.3 |
| | | | | product | Tx7ACAC-3'PO4 | 1115.8 |
| | | | | N + 1 unblocked | Tx7ACAC | 1089.2 |
| Tx7ATGT-3'PO4 | Tx7ATG | 3'PO4-dTTP | 10 | substrate | Tx7ATG | 1003.7 |
| | | | | product | Tx7ATGT-3'PO4 | 1131.7 |
| | | | | N + 1 unblocked | Tx7ATGT | 1105.1 |
| Tx7ACAG-3'PO4 | Tx7ACA | 3'PO4-dGTP | 11 | substrate | Tx7ACA | 993.3 |
| | | | | product | Tx7ACAG-3'PO4 | 1129.7 |
| | | | | N + 1 unblocked | Tx7ACAG | 1103.1 |

TABLE 4.1-continued

HPLC-MS/MS Analysis of Oligonucleotides—Method A

| | | | | | | |
|---|---|---|---|---|---|---|
| Tx7ATGA-3'PO4 | Tx7ATG | 3'PO4-dATP | 12 | substrate | Tx7ATG | 1003.7 |
| | | | | product | Tx7ATGA-3'PO4 | 1134.7 |
| | | | | N + 1 unblocked | Tx7ATGA | 1108.1 |
| Tx7CGGG-3'PO4 | Tx7CGG | 3'PO4-dGTP | 13 | substrate | Tx7CGG | 1004 |
| | | | | product | Tx7CGGG-3'PO4 | 1140.4 |
| | | | | N + 1 unblocked | Tx7CGGG | 1113.8 |
| Tx7CTGC-3'PO4 | Tx7CTG | 3'PO4-dCTP | 14 | substrate | Tx7CTG | 995.7 |
| | | | | product | Tx7CTGC-3'PO4 | 1118.7 |
| | | | | N + 1 unblocked | Tx7CTGC | 1092.1 |
| Tx7CGAC-3'PO4 | Tx7CGA | 3'PO4-dCTP | 15 | substrate | Tx7CGA | 998.7 |
| | | | | product | Tx7CGAC-3'PO4 | 1121.7 |
| | | | | N + 1 unblocked | Tx7CGAC | 1095.1 |
| Tx7CCGC-3'PO4 | Tx7CCG | 3'PO4-dCTP | 16 | substrate | Tx7CCG | 990.7 |
| | | | | product | Tx7CCGC-3'PO4 | 1113.7 |
| Tx7CGGC-3'PO4 | Tx7CGG | 3'PO4-dCTP | 17 | substrate | Tx7CGG | 1004 |
| | | | | product | Tx7CGGC-3'PO4 | 1127 |
| | | | | N + 1 unblocked | Tx7CGGC | 1100.4 |
| Tx7ACAA-3'PO4 | Tx7ACA | 3'PO4-dATP | 18 | substrate | Tx7ACA | 993.3 |
| | | | | product | Tx7ACAA-3'PO4 | 1124.4 |
| | | | | N + 1 unblocked | Tx7ACAA | 1097.8 |
| | | | | N + 2 unblocked | Tx7ACAAA | 1202.2 |
| | | | | N + 2 blocked | Tx7ACAAA-3'PO4 | 1228.8 |
| Tx7ATCC-3'PO4 | Tx7ATC | 3'PO4-dCTP | 19 | substrate | Tx7ATC | 990.1 |
| | | | | product | Tx7ATCC-3'PO4 | 1112.8 |
| | | | | N + 1 unblocked | Tx7ATCC | 1086.5 |
| | | | | N + 2 unblocked | Tx7ATCCC | 1182.5 |
| | | | | N + 2 blocked | Tx7ATCCC-3'PO4 | 1209.2 |
| | | | | (N-1)+1 blocked | Tx7ATC-3'PO4 | 1017.0 |
| Tx7ACAA-3'PO4 | Tx7ACA | 3'PO4-dATP | 20 | substrate | Tx7ACA | 993.3 |
| | | | | product | Tx7ACAA-3'PO4 | 1124.4 |
| | | | | N − 1 unblocked | Tx7AC | 888.9 |
| | | | | N + 1 unblocked | Tx7ACAA | 1097.8 |
| | | | | N + 2 blocked | Tx7ACAAA-3'PO4 | 1228.8 |
| Tx7ACAT-3'PO4 | Tx7ACA | 3'PO4-dTTP | 21 | substrate | Tx7ACA | 993.3 |
| | | | | product | Tx7ACAT-3'PO4 | 1121.4 |
| | | | | N − 1 unblocked | Tx7AC | 888.9 |
| | | | | N + 1 unblocked | Tx7ACAA | 1097.8 |
| | | | | N + 2 blocked | Tx7ACAAT-3'PO4 | 1225.8 |
| | | | | blocked | | |
| Tx7ATCA-3'PO4 | Tx7ATC | 3'PO4-dATP | 22 | substrate | Tx7ATC | 990.1 |
| | | | | product | Tx7ATCA-3'PO4 | 1121.0 |
| | | | | N − 1 unblocked | Tx7AT | 894.0 |
| | | | | N + 1 unblocked | Tx7ATCC | 1086.5 |
| | | | | N + 2 blocked | Tx7ATCCA-3'PO4 | 1217.8 |
| Tx7ATCT-3'PO4 | Tx7ATC | 3'PO4-dTTP | 23 | substrate | Tx7ATC | 990.1 |
| | | | | product | Tx7ATCT-3'PO4 | 1118.1 |
| | | | | N − 1 unblocked | Tx7AT | 894.0 |
| | | | | N + 1 unblocked | Tx7ATCC | 1086.5 |
| | | | | N + 2 blocked | Tx7ATCCT-3'PO4 | 1214.8 |
| Tx7CGGG-3'PO4 | Tx7CGG | 3'PO4-dGTP | 24 | substrate | Tx7CGG | 1004 |
| | | | | product | Tx7CGGG-3'PO4 | 1140.4 |
| | | | | N + 1 unblocked | Tx7CGGG | 1113.8 |
| | | | | N + 2 unblocked | Tx7CGGGG | 1140.4 |
| | | | | N + 2 blocked | Tx7CGGGG-3'PO4 | 1250.1 |
| | | | | (N − 1) + 1 blocked | Tx7CGG-3'PO4 | 1030.6 |

Example 5

HPLC-MS/MS Analysis of Oligonucleotides—Method B (LTQ)

Reactions were quenched as described in each example. Quenched and clarified reaction supernatant (50 μL) was then transferred to a BioRad PCR plate for LCMS analysis. The samples were analyzed according to the LTQ analytical method summarized in Table 5.1.

TABLE 5.1

HPLC-MS/MS Analysis of Oligonucleotides—Method B

| | |
|---|---|
| Instrument | Thermo Accela, Thermo LTQ XL |
| Column | Phenomenex Clarity Oligo-MS 100A, 50 × 2.1 mm, 2.6 μm with Phenomenex Security Guard cartridge, C18, 2 mm ID |
| Mobile Phases | A: 389 mM hexafluoroisopropanol (HFIP), 13.6 mM triethylamine (TEA), in water, B: mobile phase A diluted 50/50 in methanol (194 mM HFIP, 6.8 mM TEA, in 50% methanol); needle wash: 95/5 water/acetonitrile. |
| Gradient | Gradient from 98% A to 5% A and back again: |

| Time (min) | % A |
|---|---|
| 0.0 | 98 |
| 0.5 | 98 |
| 1.0 | 5 |
| 2.0 | 5 |
| 2.25 | 98 |
| 4.5 | 98 |

| | |
|---|---|
| Flow rate | 0.4 mL/min |
| Run time | 4.5 min |
| Peak retention times | 2.0 min (analytes co-elute) |
| Column temperature | 35° C. |
| Injection volume | 10 μL |
| MS detection conditions | Scan type: SIM; polarity; negative; scan rate: normal |
| MS source conditions | Sheath gas: 20; aux gas: 10; sweep gas: 0; spray voltage: 5; capillary temperature: 375° C.; capillary voltage: −6 |
| Analyte charge state | $[M-2H]^{2-}$ |

| Product Name | Substrate Name | dNTP | method | what | analyte | m/z value |
|---|---|---|---|---|---|---|
| Tx7ATCT-3'PO4 | Tx7ATC | 3'PO4-dTTP | LTQ 1 | substrate | Tx7ATC | 1485.3 |
| | | | | product | Tx7ATCT-3'PO4 | 1677.2 |
| Tx7ATCG-3'PO4 | Tx7ATC | 3'PO4-dGTP | LTQ 2 | substrate | Tx7ATC | 1485.5 |
| | | | | product | Tx7ATCG-3'PO4 | 1689.5 |
| Tx7ACAC-3'PO4 | Tx7ACA | 3'PO4-dCTP | LTQ 3 | substrate | Tx7ACA | 1489.8 |
| | | | | product | Tx7ACAC-3'PO4 | 1674.3 |

Example 6

RapidFire SPE-MS/MS Analysis of Oligonucleotides

Traditional high throughput analytical techniques, such as reversed phase HPLC-MS/MS, are powerful tools for the analysis of oligonucleotides; however, the analysis speed is slow and requires the use of ion pairing agents and electrospray modifiers. The usage of ion-pairing agents such as TEA (triethylamine), DBA (Diethyamine), DIPEA (diisopropylethylamine) and an electrospray modifier such as HFIP (1,1,1,3,3,3-hexafluoro-2-propanol), HFMIP (1,1,1,3,3,3-hexafluoro-2-methyl-2-propanol) was known to create major ion suppression in positive mode analysis. An ultra high throughput solid phase extraction method, RapidFire, using a hydrophilic interaction liquid chromatographic (HILIC) cartridge was developed to purify the reaction samples for fast MS analysis. Unlike reverse phase chromatography where hydrophobic stationary has a strong affinity for non-polar compounds, HILIC uses polar stationary phase in conjunction with a combination of low polar and non-polar solvents to retain hydrophilic, polar, or charged compounds. There was no chromatographic separation in RapidFire; the oligonucleotide of interest can be retained and detected with HILIC conditions using 2.5-12.5 mM ammonium acetated buffer between pH 5.5 to pH 5.8 in the loading buffer with extended equilibration time, extra washing, and a combination of 70% ACN 30% aqueous buffer pH 8-8.5 elution, which allowed the retention and detection of 5-11 oligonucleotides on the Rapid-Fire system within 18-22 seconds and without having to use any ion-pairing reagent.

Figure 4:
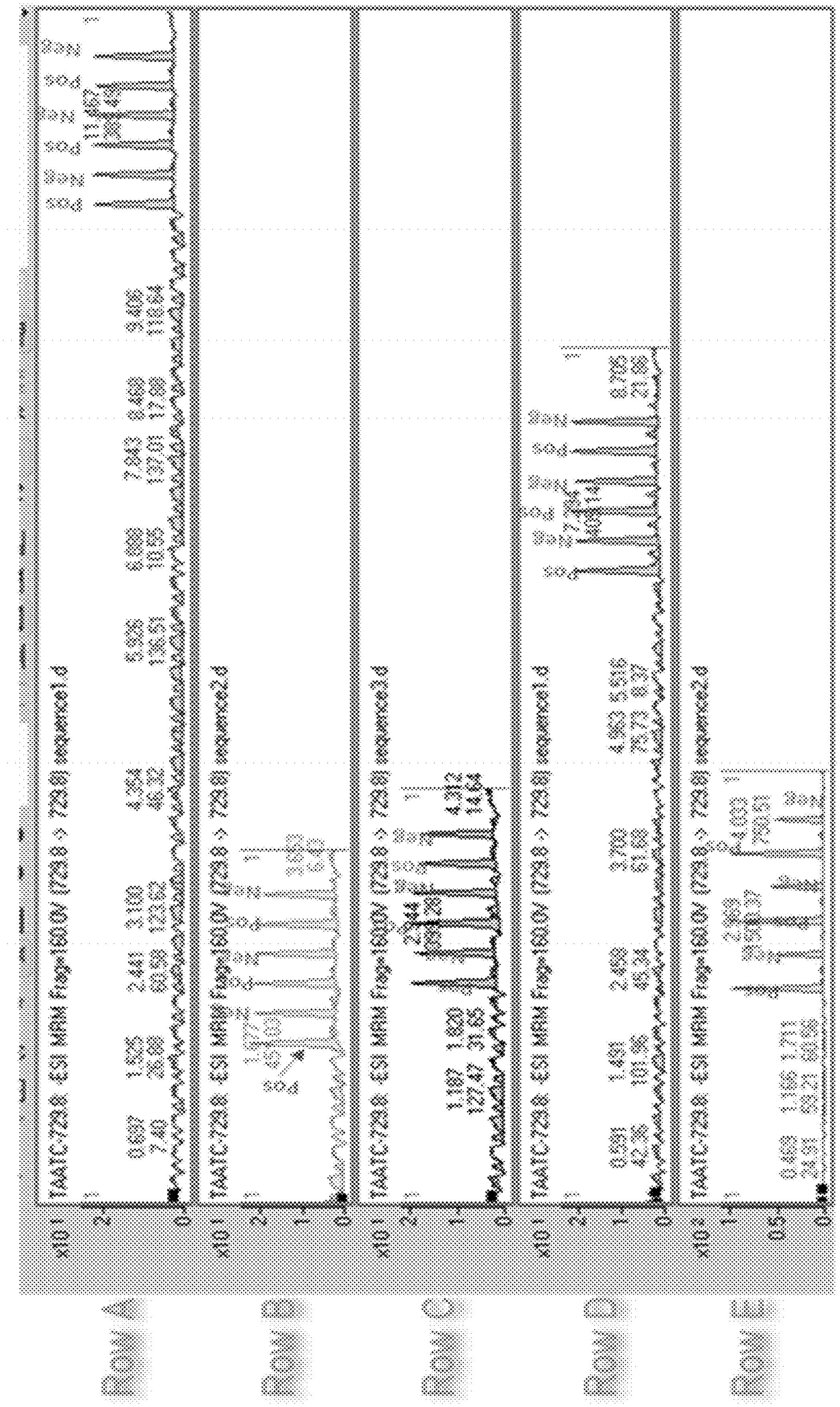
FIG. 4 depicts evaluation of the binding and detection of TAATC, as described in Example 6, below.

Evaluation of Oligonucleotide Retention and Detection:

A large batch of negative reaction matrix of 50 uM 3P-dTTP, 1×MOP buffer pH 7.2, 0.0002U inorganic pyrophosphatase, 25% high throughput clarified negative lysate, and 0.25 mM cobalt was prepared. A mock positive sample was created by adding 12 uM of 5mers oligonucleotide, TAATC standard spiked into a negative reaction matrix. The mock positive and negative samples were quenched with 5.5× (4.5 volumes of 90% acetonitrile 10 MEOH) and centrifuged at 4,000 rpm at 4° C.° for 10 minutes. Supernatants were collected, and alternating positive and negative samples were injected in triplicates on to the HILIC cartridge under various solid phase extraction conditions shown in Table 6.1 below. The retention of oligonucleotide on the HILIC cartridge is indicated by the difference in signal between positive and negative samples. Initial detection of oligonucleotide retention in the HILIC cartridge was observed at 2.5 mM of ammonium acetate additive at pH 5.7 with acetonitrile and combined with a longer loading time, as shown in FIG. 4, Row E. See Table 6.2 for Rapid Fire parameters. The combination of extended loading time and ammonium acetate additive in the loading buffer at pH 5.7 allowed the oligonucleotide of interest to bind to the HILIC cartridge, while the non-specific signals were washed out during loading. Extra loading times reduced the non-specific signal in negative control, because in solid phase extraction, samples are normally washed simultaneously while being loaded into the cartridge.

TABLE 6.1

SPE Condition Evaluated for Oligonucleotide Retention

| HILIC Conditions | Oligonucleotide | FIG. 4 |
|---|---|---|
| 0.8 mL-min 1.75 Sec 10% of 25 mM Ammonium Formate pH 4.65 and 90% ACN Load, 0.8 mL-min 3 S 60% H2O 40% MEOH Elute; 4 S Re-equilibration | TAATC | Row A |
| 0.8 mL-min 1.75 Sec 20% of 25 mM Ammonium Formate pH 4.65 and 80% ACN Load, 0.8 mL-min 3 S 60% H2O 40% MEOH Elute; 4 S Re-equilibration | TAATC | Row B |
| 0.8 mL-min 1.75 Sec 30% of 25 mM Ammonium Formate pH 4.65 and 70% ACN Load, 0.8 mL-min 3 S 60% H2O 40% MEOH Elute; 4 S Re-equilibration | TAATC | Row C |
| 0.8 mL-min 1.75 Sec 10% of 25 mM Ammonium Acetate pH 5.7 and 90% ACN Load, 0.8 mL-min 3 S 60% H2O 40% MEOH Elute; 4 S Re-equilibration | TAATC | Row D |
| 0.8 mL-min 4 Sec 10% of 25 mM Ammonium Acetate pH 5.7 and 90% ACN Load, 0.8 mL-min 3 S 60% H2O 40% MEOH Elute; 4 S Re-equilibration | TAATC | Row E |

TABLE 6.2

RapidFire SPE-MS Conditions for TAATC Detection.
Agilent RapidFire Conditions

| | |
|---|---|
| Buffer A | 10% 25 mM ammonium acetate pH 5.7 LC/MS grade water, 90% acetonitrile LC/MS grade; 0.8 mL/min flow rate (Pump1) |
| Buffer B | 40% methanol LC/MS grade, 60% water LC/MS grade; 1.25 mL/min flow rate (Pump2) |
| Buffer C | 40% methanol LC/MS grade, 60% water LC/MS grade; 0.8 mL/min flow rate (Pump3) |
| Aqueous wash | Water |
| Organic wash | Acetonitrile |
| SPE cartridge | Agilent RapidFire cartridge H (HILIC) |
| RF state 1 | 600 ms |
| RF state 2 | 4000 ms |
| RF state 3 | 1000 |
| RF state 4 | 3000 ms |
| RF state 5 | 4000 ms |

TABLE 6.2-continued

RapidFire SPE-MS Conditions for TAATC Detection.
Agilent RapidFire Conditions

Agilent Jet Stream source parameters

| | |
|---|---|
| Drying gas temperature | 300° C. |
| Drying gas flow | 10 L/min |
| Nebulizer pressure | 40 psi |
| Sheath gas temperature | 250° C. |
| Sheath gas flow | 10 L/min |
| Capillary voltage | −2500 V |
| Nozzle voltage | −2000 V |

Agilent 6470 Triple Quadrupole MRM parameters

| Compound | Q1 | Q3 | Dwell | Fragmentor | CE | CAV |
|---|---|---|---|---|---|---|
| TAATC_729.8 | 729.8 | 729.8 | 82 | 160 | 0 | 4 |
| TAATC_729.8 | 729.8 | 714.2 | 82 | 160 | 24 | 4 |
| TAATC_729.8 | 729.8 | 610.3 | 82 | 160 | 26 | 4 |

Optimization of Oligonucleotide Retention and Detection:

The retention of oligonucleotide, 5-11 mers can be improved via the optimization of loading, washing, and elution steps of the extraction method. A positive reaction sample was created with purified TdT polymerase enzyme, 4 uM TTTTTTTATC (substrate), 50 uM 3P-dTTP, 1×MOP buffer pH 7.2, 0.002U inorganic pyrophosphatase, and 0.25 mM cobalt. A negative reaction sample was prepared with the same components, except with lysate containing no TdT polymerase. Both positive and negative samples were quenched with two volumes of a mixture of 90% acetonitrile with 10% MEOH and centrifuged at 4,000 rpm for 10 minutes. Supernatants of positive and negative samples were collected and injected on to the HILIC cartridge in alternating pattern. Table 6.3, below, shows the various solid phase extraction conditions tested. Signal of Tx7ATC significantly increased when loading buffer composition changed from 10% of 25 mM ammonium acetate, pH 5.8 (condition 2) to 15% of 25 mM ammonium acetate, pH 5.8 (condition 3). A change in the organic and aqueous solvent contents enhanced the solubility, binding, and ionization of the Tx7ATC, and, therefore, boosted the signal of the positive sample significantly. Furthermore, the rate of sample loading, sample washing, the content of organic in the loading, washing, and elution buffer can significantly affect the overall signal. Similar sequence of oligonucleotides can be retained and detected with 10%-30% of aqueous ammonium acetate buffer at 50 mM between pH 5.5-5.8. Table 6.4, below, shows the final improved Rapidfire condition for T7ATC.

TABLE 6.3

| SPE condition | Detailed SPPE conditions |
|---|---|
| 1 | 90% ACN 10% 25 mM Ammonium Acetate pH5.8_load, 50% ACN 10% Ammonium bicarb pH 7.5 elute |
| 2 | 90% ACN 10% 25 mM Ammonium Acetate pH5.8_load, 50% ACN 10% Ammonium bicarb pH 8 elute |
| 3 | 85% ACN 15% 25 mM Ammonium Acetate pH5.8_load, 50% ACN 10% Ammonium bicarb pH 7.5 elute |
| 4 | 85% ACN 15% 25 mM Ammonium Acetate pH5.8_load, 60% ACN 10% Ammonium bicarb pH 7.5 elute |
| 5 | 85% ACN 15% 25 mM Ammonium Acetate pH5.8_load, 40% ACN 10% Ammonium bicarb pH 7.5 elute |
| 6 | 0.6 mL-min 85% ACN 15% 25 mM Ammonium Acetate pH5.8 load; 1 S Extra wash; 60% ACN 10% Ammonium bicarb pH 7.5 elute |

TABLE 6.3-continued

| SPE condition | Detailed SPPE conditions |
|---|---|
| 7 | 0.6 mL-min 85% ACN 15% 25 mM Ammonium Acetate pH5.8 load; NO Extra wash; 60% ACN 10% Ammonium bicarb pH 7.5 elute |
| 8 | 0.4 mL-min 85% ACN 15% 25 mM Ammonium Acetate pH5.8 load; NO Extra wash; 60% ACN 10% Ammonium bicarb pH 7.5 elute |
| 9 | 0.4 mL-min 85% ACN 15% 25 mM Ammonium Acetate pH5.8 load; 1 S Extra wash; 60% ACN 10% Ammonium bicarb pH 7.5 elute |
| 10 | 0.6 mL-min 80% ACN 20% 25 mM Ammonium Acetate pH5.8 load; 1 S Extra wash; 60% ACN 10% Ammonium bicarb pH 7.5 elute |

TABLE 6.4

| RapidFire SPE-MS Conditions for TTTTTTTATC Detection. Agilent RapidFire Conditions | |
|---|---|
| Buffer A | 20% 20 mM ammonium acetate pH 5.8 LC/MS grade water, 80% acetonitrile LC/MS grade; 0.6 mL/min flow rate (Pump 1) |
| Buffer B | 70% acetonitrile LC/MS grade, 20% water LC/MS grade, 10% 10 mM ammonium bicarb pH 8.6 LC/MS grade; 1.25 mL/min flow rate (Pump 2) |
| Buffer C | 70% acetonitrile LC/MS grade, 20% water LC/MS grade, 10% 10 mM ammonium bicarb pH 8.6 LC/MS grade; 0.8 mL/min flow rate (Pump 3) |
| Aqueous wash | Water |
| Organic wash | Acetonitrile |
| SPE cartridge | Agilent RapidFire cartridge H6 (HILIC) |
| RF state 1 | 600 ms |
| RF state 2 | 4000 ms |
| RF state 3 | 1000 ms |
| RF state 4 | 3000 ms |
| RF state 5 | 4000 ms |
| Agilent Jet Stream source parameters | |
| Drying gas temperature | 325° C. |
| Drying gas flow | 10 L/min |
| Nebulizer pressure | 20 psi |
| Sheath gas temperature | 275° C. |
| Sheath gas flow | 10 L/min |
| Capillary voltage | −2500 V |
| Nozzle voltage | −2000 V |
| Agilent 6470 Triple Quadrupole SRM parameters | |

| RapidFire SPE-SRM Conditions for TTTTTTTATC Detection. Agilent RapidFire Conditions | | | | | |
|---|---|---|---|---|---|
| Compound | Q1 | Dwell | Fragmentor | CAV | Polarity |
| TTTTTTTATC_990.3 | 990.3 | 150 | 160 | 3 | Neg |
| TTTTTTTATC_742.5 | 742.5 | 150 | 130 | 4 | Neg |

Method Validation:

A duplicate set of TdT library reaction plates producing T7ATC-G3'Phos was generated. One set was quenched according the RapidFire method, and another was quenched according the HPLC MS/MS Ultivo method. Reaction samples were run corresponding to the quenching method's instrument. The correlation value between the RapidFire and HPLC MS/MS Thermo was 0.82.

RapidFire SPE MS/MS method for library Screening:

Reactions were quenched as described in each example. Quenched and clarified reaction supernatant (70 μL) was then transferred to a 384-well microtiter PCR plate for MS analysis. Product was detected by RapidFire SPE-MS/MS, with the instrument and parameters provided in Table 6.5.

TABLE 6.5

| RapidFire SPE-MS/MS Conditions for Tx7ATC-G3'Phos Detection. Agilent RapidFire Conditions | |
|---|---|
| Buffer A | A mixture of 75% LC/MS grade acetonitrile and 25% of 50 mM ammonium acetate pH 5.8; 1.5 mL/min flow rate |

TABLE 6.5-continued

| | |
|---|---|
| Buffer B | A mixture of 60% LC/MS grade acetonitrile, 30% of LC/MS grade water, and 10% of 50 mM LC/MS grade ammonium bicarbonate pH 8.0; 1.5 mL/min flow rate |
| Buffer C | A mixture of 70% LC/MS grade acetonitrile, 30% of 50 mM LC/MS grade ammonium bicarbonate pH 8.0; 0.8 mL/min flow rate |
| Aqueous wash | Water |
| Organic wash | Acetonitrile |
| SPE cartridge | Agilent RapidFire cartridge H6 |
| RF state 1 | 120 ms |
| RF state 2 | 5000 ms |
| RF state 3 | 1500 ms |
| RF state 4 | 4500 ms |
| RF state 5 | 4000 ms |

Agilent Jet Stream Source Parameters

| | |
|---|---|
| Drying gas temperature | 325° C. |
| Drying gas flow | 10 L/min |
| Nebulizer pressure | 20 psi |
| Sheath gas temperature | 325° C. |
| Sheath gas flow | 10 L/min |
| Capillary voltage | −5000 V |
| Nozzle voltage | −2000 V |

Agilent 6470 Triple Quadrupole MS2 SIM Parameters

| RF Method | Product | m/3z (Quantifier) | RT | m/4Z | RT |
|---|---|---|---|---|---|
| 1 | Tx7ATCG-3'PO4 | 1126.7 | 0.151 | 844.8 | 0.151 |
| 2 | Tx7ATCT-3'PO4 | 1118.2 | 0.151 | 834.5 | 0.163 |
| 3 | Tx7ATCC-3'PO4 | 1113.2 | 0.151 | 834.5 | 0.163 |
| 4 | Tx7ACAT-3'PO4 | 1121.4 | 0.185 | 840.8 | 0.188 |
| 5 | Tx7ATGA-3'PO4 | 1134.7 | 0.164 | 850.8 | 0.157 |
| 6 | Tx7ACAG-3'PO4 | 1129.7 | 0.160 | 847.1 | 0.164 |
| 7 | Tx7CGGG-3'PO4 | 1127.1 | 0.143 | 845.1 | 0.145 |

Example 7

Improvements Over SEQ ID NO: 4 in the Extension of Oligonucleotide Acceptor Molecules with Nucleotide Triphosphate Donors HTP Screening for Improved TdT Variants SEQ ID NO: 4 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 7.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 7.1. The quenched reactions were centrifuged at 4,000 rpm for 10 min at 4° C. to pellet any precipitate. Supernatant was then transferred into new HTP plates for analytical analysis as described in Table 7.1.

TABLE 7.1

| All lysis, purification, reaction, quench, and analytical properties |
|---|
| Lysis and purification conditions: Lysis buffer—Tris-HCl, pH 8, 300 μM NaCl, 0.2 g/L lysozyme from chicken egg white; Lysis buffer volume—300 μL; Lysate pre-treatment—Lysates were pre-incubated at 45° C. for 60 min, then centrifuged at 4,000 rpm for 10 min. The clarified supernatants were used in reactions. |
| Reaction conditions: Oligonucleotide—2 μM TAATT; Nucleotide triphosphate—100 μM 2',3'-dideoxythymidine 5'-triphosphate (ddTTP); Reaction buffer—20 mM Tris-acetate, pH 8, 0.002 Unit/μL yeast pyrophosphatase (Thermo Scientific), 50 mM potassium acetate, 250 μM cobalt (II) chloride; Reaction volume—20 μL; Lysate dilution—None; Reaction temperature—45° C.; Reaction time—1 hour |
| Quench conditions: Quench solution and volume—Reactions were quenched by the addition of 24 μL acetonitrile. The solutions were mixed well and then further diluted |

TABLE 7.1-continued

| All lysis, purification, reaction, quench, and analytical properties |
|---|
| by the addition of 16 μL of 20 mM aqueous EDTA.; Plate type and seal-96-well BioRad PCR plate with a plastic seal<br>Analytical conditions: Instrument—Agilent UHPLC 1260 prime series, Agilent Ultivo—see Example 4; Reaction product detected—TAATTddT |

Activity relative to SEQ ID NO: 4 (Activity FIOP) was calculated as the product peak area of the variant compared with the product peak area observed by the reaction with SEQ ID NO: 4 (where the peak area may be set as the average of replicates or else the highest single sample as appropriate). The results are shown in Table 7.2.

TABLE 7.2

| SEQ ID NO: (nt/aa) | Amino Acid Differences (Relative to SEQ ID NO: 4) | FIOP Product Peak Area Relative to SEQ ID NO: 4 |
|---|---|---|
| 5/6 | E238G | +++ |
| 7/8 | Y80S | +++ |
| 9/10 | S296V | +++ |
| 11/12 | K158R | +++ |
| 13/14 | S24E | +++ |
| 15/16 | L20S | +++ |
| 17/18 | K353N | +++ |
| 19/20 | F67K | +++ |
| 21/22 | F67R | +++ |
| 23/24 | N295D | +++ |
| 25/26 | D103S | +++ |
| 27/28 | E21G | +++ |
| 29/30 | N295S | +++ |
| 31/32 | I66R | +++ |
| 33/34 | S200A | +++ |
| 35/36 | K161S | ++ |
| 37/38 | E111R | ++ |
| 39/40 | N197G | ++ |
| 41/42 | Q267G | ++ |
| 43/44 | G373D | ++ |
| 45/46 | T192S | ++ |
| 47/48 | D99S | ++ |
| 49/50 | R28S/S304L | ++ |
| 51/52 | K167E | ++ |
| 53/54 | I258C | ++ |
| 55/56 | L20F | ++ |
| 57/58 | A27G | ++ |
| 59/60 | N295W | ++ |
| 61/62 | L20G | ++ |
| 63/64 | P233G | ++ |
| 65/66 | K219W | ++ |
| 67/68 | T17R | ++ |
| 69/70 | S24Q | ++ |
| 71/72 | S297L | ++ |
| 73/74 | L268E | ++ |
| 75/76 | L246G | ++ |
| 77/78 | K303G | ++ |
| 79/80 | V180T | ++ |
| 81/82 | M306L | ++ |
| 83/84 | S24V | + |
| 85/86 | K219A | + |
| 87/88 | E19S | + |
| 89/90 | T300S | + |
| 91/92 | I66L | + |
| 93/94 | S304E | + |
| 95/96 | E235V | + |
| 97/98 | T201R | + |
| 99/100 | V140I | + |
| 101/102 | V180A | + |
| 103/104 | S304W | + |
| 105/106 | K170Q | + |
| 107/108 | D160S | + |
| 109/110 | I66E | + |
| 111/112 | E235D | + |
| 113/114 | K249T | + |
| 115/116 | S115R | + |
| 117/118 | I66A | + |

TABLE 7.2-continued

| SEQ ID NO: (nt/aa) | Amino Acid Differences (Relative to SEQ ID NO: 4) | FIOP Product Peak Area Relative to SEQ ID NO: 4 |
|---|---|---|
| 119/120 | D103R | + |
| 121/122 | E235S | + |
| 123/124 | P14G | + |
| 125/126 | A159L | + |
| 127/128 | S200R | + |
| 129/130 | R367C | + |
| 131/132 | E113Q | + |
| 133/134 | K219R | + |
| 135/136 | V22D | + |
| 137/138 | S297A | + |
| 139/140 | H350V | + |
| 141/142 | P233R | + |
| 143/144 | A27Y | + |
| 145/146 | C68R | + |
| 147/148 | T322V | + |
| 149/150 | N295V | + |
| 151/152 | M55I | + |
| 153/154 | I273R | + |
| 155/156 | C256G | + |
| 157/158 | S297V | + |

Levels of increased activity were determined relative to the reference polypeptide of SEQ ID NO: 4 and defined as follows: "+" 1.30 to 2.50, "++" >2.50, "+++" >7.50

Example 8

Improvements Over SEQ ID NO: 4 in the Extension of Oligonucleotide Acceptor Molecules with Nucleotide Triphosphate Donors HTP Screening for Improved TdT Variants SEQ ID NO: 4 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 8.1.

Reactions were performed in 96-well format 200 L Bio-Rad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 8.1. The quenched reactions were centrifuged at 4,000 rpm for 10 mi at 4° C. to pellet any precipitate. Supernatant was then transferred into new HTP plates for analytical analysis as described in Table 8.1.

TABLE 8.1

| All lysis, purification, reaction, quench, and analytical properties |
|---|
| Lysis and purification conditions: Lysis buffer—20 mM Tris-HCl, pH 8, 300 mM NaCl, 0.2 g/L lysozyme from chicken egg white; Lysis buffer volume—300 μL; Lysate pre-treatment—Lysates were preincubated at 49° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide—2 μM TAATT; Nucleotide triphosphate—100 μM ddTTP; Reaction buffer—20 mM Tris-acetate, pH 8, 0.002 Unit/μL yeast pyrophosphatase (Thermo Scientific), 50 mM potassium acetate, 250 μM cobalt (II) chloride; Reaction volume—20 μL; Lysate dilution—None; Reaction temperature—49° C.; Reaction time—60 minutes |
| Quench conditions: Quench solution and volume—Reactions were quenched by the addition of 24 μL acetonitrile. The solutions were mixed well and then further diluted by the addition of 16 μL of 20 mM aqueous EDTA.; Plate type and seal-96-well BioRad PCR plate with a plastic seal |
| Analytical conditions: Instrument—Agilent UHPLC 1260 prime series, Agilent Ultivo—see Example 4; Reaction product detected—TAATTddT |

Activity relative to SEQ ID NO: 4 (Activity FIOP) was calculated as the product peak area of the variant compared with the product peak area observed by the reaction with SEQ ID NO: 4 (where the peak area may be set as the average of replicates or else the highest single sample as appropriate). The results are shown in Table 8.2.

TABLE 8.2

| SEQ ID NO: (nt/aa) | Amino Acid Differences (Relative to SEQ ID NO: 4) | FIOP Product Peak Area Relative to SEQ ID NO: 4 |
|---|---|---|
| 159/160 | L157I | +++ |
| 161/162 | M55L | +++ |
| 163/164 | C256E | +++ |
| 165/166 | R87S | +++ |
| 167/168 | F67N | +++ |
| 169/170 | C68R | +++ |
| 171/172 | L157A | +++ |
| 173/174 | E111T | +++ |
| 175/176 | D160N/S296W | +++ |
| 177/178 | R28F | +++ |
| 179/180 | S200A | ++ |
| 181/182 | G373R | ++ |
| 183/184 | E63G | ++ |
| 185/186 | I315V | ++ |
| 187/188 | F67D | ++ |
| 189/190 | S10Q | ++ |
| 191/192 | S297T | ++ |
| 193/194 | I66V | ++ |
| 195/196 | G373D | ++ |
| 197/198 | F67A | ++ |
| 199/200 | C68R/K118H | ++ |
| 201/202 | K62M | ++ |
| 203/204 | N295V | + |
| 205/206 | K219P | + |
| 207/208 | R28S | + |
| 209/210 | D160T | + |
| 211/212 | E106R | + |
| 213/214 | S181R | + |
| 215/216 | L246C | + |
| 217/218 | S296G | + |
| 219/220 | A27G | + |
| 221/222 | I315G | + |
| 223/224 | L20S | + |
| 225/226 | F263A | + |
| 227/228 | D103H | + |
| 229/230 | D160C | + |
| 231/232 | Q131E | + |

TABLE 8.2-continued

| SEQ ID NO: (nt/aa) | Amino Acid Differences (Relative to SEQ ID NO: 4) | FIOP Product Peak Area Relative to SEQ ID NO: 4 |
|---|---|---|
| 233/234 | T17D | + |
| 235/236 | E155S | + |
| 237/238 | E177S | + |
| 239/240 | G292S | + |

Levels of increased activity were determined relative to the reference polypeptide of SEQ ID NO: 4 and defined as follows: "+" 1.01 to 2.00, "++" >2.00, "+++" >5.00

Example 9

Improvements Over SEQ ID NO: 4 in the Extension of Oligonucleotide Acceptor Molecules with Nucleotide Triphosphate Donors HTP Screening for Improved TdT Variants SEQ ID NO: 4 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 9.1.

Reactions were performed in 96-well format 200 dL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 9.1. The quenched reactions were centrifuged at 4,000 rpm for 10 min at 4° C. to pellet any precipitate. Supernatant was then transferred into new HTP plates for analytical analysis as described in Table 9.1.

TABLE 9.1

| All lysis, purification, reaction, quench, and analytical properties |
|---|
| Lysis and purification conditions: Lysis buffer—20 mM Tris-HCl, pH 8, 300 mM NaCl, 0.2 g/L lysozyme from chicken egg white; Lysis buffer volume—300 μL; Lysate pre-treatment—Lysates were preincubated at 49° C. for one hour, then centrifuged at 4,000 rpm for 10 min as described in |

TABLE 9.1-continued

| All lysis, purification, reaction, quench, and analytical properties |
|---|
| Example 2 [Lysis of HTP Cell Pellets with Lysozyme]. The clarified supernatants were used in reactions.<br>Reaction conditions: Oligonucleotide—2 μM TAATT; Nucleotide triphosphate—50 μM ddTTP; Reaction buffer—20 mM Tris-acetate, pH 8, 0.002 Unit/μL yeast pyrophosphatase (Thermo Scientific), 50 mM potassium acetate, 250 μM cobalt (II) chloride; Reaction volume—20 μL; Lysate dilution—None; Reaction temperature—49° C.; Reaction time—60 minutes<br>Quench conditions: Quench solution and volume—Reactions were quenched by the addition of 24 μL acetonitrile. The solutions were mixed well and then further diluted by the addition of 16 μL of 20 mM aqueous EDTA.; Plate type and seal-96-well BioRad PCR plate with a plastic seal<br>Analytical conditions: Instrument—Agilent UHPLC 1260 prime series, Agilent Ultivo—see Example 4; Reaction product detected—TAATTddT |

Activity relative to SEQ ID NO: 4 (Activity FIOP) was calculated as the product peak area of the variant compared with the product peak area observed by the reaction with SEQ ID NO: 4 (where the peak area may be set as the average of replicates or else the highest single sample as appropriate). The results are shown in Table 9.2.

TABLE 9.2

| SEQ ID NO: (nt/aa) | Amino Acid Differences (Relative to SEQ ID NO: 4) | FIOP Product Peak Area Relative to SEQ ID NO: 4 |
|---|---|---|
| 241/242 | F173L | +++ |
| 139/140 | H350V | +++ |
| 211/212 | E106R | +++ |
| 243/244 | L157V | +++ |
| 245/246 | K185R | +++ |
| 247/248 | D99P | +++ |
| 249/250 | E235Q | +++ |
| 251/252 | L268V | +++ |
| 165/166 | R87S | +++ |
| 253/254 | F52L | +++ |
| 255/256 | K353A | +++ |
| 205/206 | K219P | +++ |
| 25/26 | D103S | +++ |
| 17/18 | K353N | +++ |
| 207/208 | R28S | +++ |
| 257/258 | S296R | +++ |
| 209/210 | D160T | +++ |
| 145/146 | C68R | +++ |
| 259/260 | S24Y | +++ |
| 261/262 | S296W | +++ |
| 163/164 | C256E | +++ |
| 263/264 | D237R | +++ |
| 229/230 | D160C | +++ |
| 265/266 | A307I | +++ |
| 155/156 | C256G | +++ |
| 267/268 | S162R | +++ |
| 269/270 | K272G | +++ |
| 37/38 | E111R | +++ |
| 271/272 | T322R | +++ |
| 273/274 | Q280C | +++ |
| 275/276 | V30P | +++ |
| 277/278 | S296Y | +++ |
| 279/280 | S297P | +++ |
| 281/282 | F67G | +++ |
| 159/160 | L157I | +++ |
| 19/20 | F67K | +++ |
| 99/100 | V140I | +++ |
| 283/284 | K371I | +++ |
| 201/202 | K62M | ++ |
| 285/286 | S10D | ++ |
| 239/240 | G292S | ++ |
| 287/288 | GUR | ++ |
| 79/80 | V180T | ++ |
| 289/290 | Y289G | ++ |
| 291/292 | L246V | ++ |
| 183/184 | E63G | ++ |
| 293/294 | R102W | ++ |
| 295/296 | S24T | ++ |
| 297/298 | E144R | ++ |
| 299/300 | Q92M | ++ |

TABLE 9.2-continued

| SEQ ID NO: (nt/aa) | Amino Acid Differences (Relative to SEQ ID NO: 4) | FIOP Product Peak Area Relative to SEQ ID NO: 4 |
|---|---|---|
| 301/302 | L193W | ++ |
| 303/304 | I355E | ++ |
| 187/188 | F67D | ++ |
| 305/306 | E308M | ++ |
| 307/308 | P84T | ++ |
| 101/102 | V180A | ++ |
| 309/310 | Q267V | ++ |
| 311/312 | D103A | ++ |
| 313/314 | F147Y | ++ |
| 175/176 | D160N/S296W | ++ |
| 315/316 | G373N | ++ |
| 317/318 | C256P | ++ |
| 191/192 | S297T | ++ |
| 319/320 | K161R | ++ |
| 321/322 | E238L | ++ |
| 323/324 | C68T | ++ |
| 325/326 | H241D | ++ |
| 167/168 | F67N | ++ |
| 327/328 | I194K | ++ |
| 329/330 | K161L | ++ |
| 173/174 | E111T | ++ |
| 331/332 | T300R | ++ |
| 197/198 | F67A | ++ |
| 333/334 | I321G | ++ |
| 7/8 | Y80S | ++ |
| 335/336 | K249Q | ++ |
| 337/338 | V180R | ++ |
| 339/340 | K62L | ++ |
| 341/342 | C68S | ++ |
| 343/344 | N42T | ++ |
| 345/346 | K365R | ++ |
| 117/118 | I66A | ++ |
| 347/348 | E156F | ++ |
| 349/350 | N122S | ++ |
| 351/352 | F263A | ++ |
| 353/354 | K366P | ++ |
| 355/356 | I66V | ++ |
| 357/358 | P291K | ++ |
| 359/360 | T201N | ++ |
| 361/362 | T198G/Y289H | ++ |
| 363/364 | N197S | ++ |
| 365/366 | T201L | ++ |
| 21/22 | F67R | ++ |
| 367/368 | E111S | ++ |
| 369/370 | K170D | ++ |
| 31/32 | I66R | ++ |
| 171/172 | L157A | ++ |
| 371/372 | N230C | ++ |
| 373/374 | F263K | ++ |
| 215/216 | L246C | ++ |
| 375/376 | S10G | ++ |
| 377/378 | I26L | ++ |
| 379/380 | S200C | ++ |
| 381/382 | Y175D | ++ |
| 383/384 | D103L | ++ |
| 385/386 | D103Q | ++ |
| 387/388 | Q290K | + |
| 389/390 | E111I | + |

TABLE 9.2-continued

| SEQ ID NO: (nt/aa) | Amino Acid Differences (Relative to SEQ ID NO: 4) | FIOP Product Peak Area Relative to SEQ ID NO: 4 |
|---|---|---|
| 391/392 | F147S | + |
| 393/394 | Q92S | + |
| 395/396 | K89A | + |
| 397/398 | G8P | + |
| 399/400 | K302A | + |
| 401/402 | V101T | + |
| 403/404 | K47I | + |
| 405/406 | T262R | + |
| 407/408 | E111M | + |
| 409/410 | F147L | + |
| 411/412 | Q267W | + |
| 413/414 | V264Y | + |
| 415/416 | L286A | + |
| 417/418 | L193G | + |
| 109/110 | I66E | + |
| 419/420 | K234L | + |
| 421/422 | L174R | + |
| 213/214 | S181R | + |
| 27/28 | E21G | + |
| 423/424 | K365D | + |
| 425/426 | S200N | + |
| 427/428 | T198G | + |
| 161/162 | M55L | + |
| 429/430 | K118M | + |
| 431/432 | I109L | + |
| 433/434 | I273P | + |
| 435/436 | E238Y | + |
| 437/438 | L77V | + |
| 439/440 | H350Y | + |
| 441/442 | L163R | + |
| 443/444 | Q92D | + |
| 445/446 | Y289R | + |
| 447/448 | I321E | + |
| 449/450 | R116I | + |
| 451/452 | Q267D | + |
| 453/454 | I91L | + |
| 455/456 | I109C | + |
| 457/458 | V30G | + |
| 459/460 | Q267S | + |
| 461/462 | N295A | + |
| 61/62 | L20G | + |
| 463/464 | D189A | + |
| 465/466 | K164R | + |
| 467/468 | Q131L | + |
| 469/470 | S34H | + |
| 471/472 | Y44D | + |
| 115/116 | S115R | + |
| 473/474 | K219G | + |
| 475/476 | L207G | + |
| 477/478 | P291Q | + |
| 479/480 | N299V | + |
| 481/482 | K353F | + |
| 483/484 | E113C | + |
| 189/190 | S10Q | + |
| 485/486 | I368L | + |
| 487/488 | I273Q | + |
| 489/490 | S15G | + |
| 491/492 | Y80R | + |
| 147/148 | T322V | + |
| 493/494 | Y80T | + |
| 495/496 | D245E | + |
| 497/498 | S304A | + |
| 499/500 | V22G | + |
| 501/502 | I258S | + |
| 503/504 | L72D | + |
| 505/506 | Q290R | + |
| 507/508 | E111A | + |
| 509/510 | S24N | + |
| 511/512 | G292V | + |
| 513/514 | D123G | + |
| 515/516 | Y80C | + |
| 517/518 | E111P/R346H | + |
| 519/520 | V264T | + |
| 521/522 | I355F | + |
| 111/112 | E235D | + |
| 523/524 | S115E | + |
| 525/526 | S15F | + |

TABLE 9.2-continued

| SEQ ID NO: (nt/aa) | Amino Acid Differences (Relative to SEQ ID NO: 4) | FIOP Product Peak Area Relative to SEQ ID NO: 4 |
|---|---|---|
| 527/528 | S304K | + |
| 529/530 | T192Y | + |
| 531/532 | A284F | + |
| 533/534 | D257F | + |
| 535/536 | T300L | + |
| 537/538 | D311V | + |
| 539/540 | R116P | + |
| 89/90 | T300S | + |
| 541/542 | G8R | + |
| 543/544 | L193A | + |
| 545/546 | F48N | + |
| 547/548 | E238S | + |
| 549/550 | I54L | + |
| 551/552 | Y80G | + |
| 553/554 | E325L | + |
| 555/556 | D103E | + |
| 557/558 | K164D | + |
| 559/560 | K310G | + |
| 561/562 | N16V | + |
| 563/564 | H350E | + |
| 565/566 | T262G | + |
| 567/568 | E388Q | + |
| 121/122 | E235S | + |

Levels of increased activity were determined relative to the reference polypeptide of SEQ ID NO: 4 and defined as follows: "+" 1.24 to 3.00, "++" >3.00, "+++" >7.00

Example 10

Improvements Over SEQ ID NO: 4 in the Extension of Oligonucleotide Acceptor Molecules with Nucleotide Triphosphate Donors HTP Screening for Improved TdT Variants SEQ ID NO: 4 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 10.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 10.1. The quenched reactions were centrifuged at 4,000 rpm for 10 min at 4° C. to pellet any precipitate. Supernatant was then transferred into new HTP plates for analytical analysis as described in Table 10.1.

TABLE 10.1

| All lysis, purification, reaction, quench, and analytical properties |
|---|
| Lysis and purification conditions: Lysis buffer—20 mM Tris-HCl, pH 8, 300 mM NaCl, 0.2 g/L lysozyme from chicken egg white; Lysis buffer volume—300 µL; Lysate pre-treatment—Lysates were processed at 25° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide—2 µM TAATC; Nucleotide triphosphate—100 µM 3'PO4-dATP; Reaction buffer—20 mM Tris-acetate, pH 8, 0.002 Unit/µL yeast pyrophosphatase (Thermo Scientific), 50 mM potassium acetate, 250 µM cobalt (II) chloride; Reaction volume—20 µL; Lysate dilution—None; Reaction temperature—37° C.; Reaction time—180 minutes |
| Quench conditions: Quench solution and volume—Reactions were quenched by the addition of 24 µL acetonitrile. The solutions were mixed well and then further diluted by the addition of 16 µL of 20 mM aqueous EDTA.; Plate type and seal-96-well BioRad PCR plate with a plastic seal |
| Analytical conditions: Instrument—Agilent UHPLC 1260 prime series, Agilent Ultivo—see Example 4; Reaction product detected—TAATCA-3'PO4 |

Activity relative to SEQ ID NO: 4 (Activity FIOP) was calculated as the product peak area of the variant compared with the product peak area observed by the reaction with SEQ ID NO: 4 (where the peak area may be set as the average of replicates or else the highest single sample as appropriate). The results are shown in Table 10.2.

TABLE 10.2

| SEQ ID NO: (nt/aa) | Amino Acid Differences (Relative to SEQ ID NO: 4) | FIOP Product Peak Area Relative to SEQ ID NO: 4 |
|---|---|---|
| 569/570 | E60K | + |
| 571/572 | E60K/I259K | + |
| 573/574 | E60K/N278H | + |
| 575/576 | E65K/I259Q | + |

Levels of increased activity were determined relative to the reference polypeptide of SEQ ID NO: 4 and defined as follows: "+" 5.38 to 12.2

Example 11

Improvements Over SEQ ID NO: 4 in the Extension of Oligonucleotide Acceptor Molecules with Nucleotide Triphosphate Donors HTP Screening for Improved TdT Variants SEQ ID NO: 4 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 11.1.

Reactions were performed in 96-well format 200 µL BioRad PCR plates. Reactions included 1-4 µM oligonucleotide, 25-200 µM nucleotide triphosphate, 0.002 Unit/µL yeast pyrophosphatase (Thermo Scientific), 20 mM buffer, 50 mM potassium acetate, and 250 µM cobalt (II) chloride. The reactions were set up as follows: (i) all reaction components, except for TdT, were pre-mixed in a single solution, and 15 µL of this solution was aliquoted into each well of the 96-well plates (ii) 5 µL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 11.1. The quenched reactions were centrifuged at 4,000 rpm for 10 min at 4° C. to pellet any precipitate. Supernatant was then transferred into new HTP plates for analytical analysis as described in Table 11.1.

TABLE 11.1

| All lysis, purification, reaction, quench, and analytical properties |
|---|
| Lysis and purification conditions: Lysis buffer—20 mM Tris-HCl, pH 8, 300 mM NaCl, 0.2 g/L lysozyme from chicken egg white; Lysis buffer volume—300 µL; Lysate pre-treatment—Lysates were preincubated at 49° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide—2 µM TAATT; Nucleotide triphosphate—100 µM ddTTP; Reaction buffer—20 mM Tris-acetate, pH 8, 0.002 Unit/µL yeast pyrophosphatase (Thermo Scientific), 50 mM potassium acetate, 250 µM cobalt (II) chloride; Reaction volume—20 µL; Lysate dilution—None; Reaction temperature—49° C.; Reaction time—60 minutes |
| Quench conditions: Quench solution and volume—Reactions were quenched by the addition of 24 µL acetonitrile. The solutions were mixed well and then further diluted by the addition of 16 µL of 20 mM aqueous EDTA.; Plate type and seal-96-well BioRad PCR plate with a plastic seal |
| Analytical conditions: Instrument—Agilent UHPLC 1260 prime series, Agilent Ultivo—see Example 4; Reaction product detected—TAATTddT |

Activity relative to SEQ ID NO: 4 (Activity FIOP) was calculated as the product peak area of the variant compared with the product peak area observed by the reaction with SEQ ID NO: 4 (where the peak area may be set as the average of replicates or else the highest single sample as appropriate). The results are shown in Table 11.2.

TABLE 11.2

| SEQ ID NO: (nt/aa) | Amino Acid Differences (Relative to SEQ ID NO: 4) | FIOP Product Peak Area Relative to SEQ ID NO: 4 |
|---|---|---|
| 577/578 | L20S/C68R/D103S/V180A/S200A | +++ |
| 579/580 | L20G/E21G/C68R/D160S/V180A/S200R/L246G | +++ |
| 581/582 | L20S/C68R/S200A/E238G/L246G | +++ |
| 583/584 | E21G/C68R/D160S/V180A/S200R/S297A | +++ |
| 585/586 | C68R/E111R/S200A/E238G | +++ |
| 587/588 | E21G/C68R/V180A/E235S | +++ |
| 589/590 | L20S/C68R/D160S/E235S/S297A | +++ |
| 591/592 | L20S/C68R/D160S/V180A/P233G/E235S/L246G | +++ |
| 593/594 | E111R | +++ |
| 595/596 | L20S/C68R/D160S/V180A | +++ |
| 597/598 | E21G/C68R/S200R | +++ |
| 599/600 | L20S/E21G/C68R/P233G/L246G/S297A | ++ |
| 601/602 | L20S/C68R/D160S/L246G | ++ |
| 603/604 | E21G/C68R/E111R/S200R | ++ |
| 605/606 | L20S/D103S/D160S/V180A/S200R/E235S | ++ |
| 607/608 | E21G/C68R/D160S/E238G/L246G | ++ |
| 609/610 | L20G/E21G/C68R/V180A | ++ |
| 611/612 | C68R | ++ |
| 613/614 | C68R/D103S/S200R/E235S/L246G/S297A | ++ |
| 615/616 | L20S/C68R/E235S/S297A | ++ |
| 617/618 | E21G/C68R/V180A | ++ |
| 619/620 | L20G/E21G/C68R/D103S/S200R/E238G/S297A | ++ |
| 621/622 | L20S/E21G/C68R/S200R/E235S/S297A | ++ |
| 623/624 | E21G/C68R | ++ |
| 625/626 | E21G/C68R/V180A/L246G | ++ |
| 627/628 | D103S/P233G | ++ |
| 629/630 | D103S/D160S/V180A | ++ |
| 631/632 | L20G/E21G/E111R/D160S/S200A | ++ |
| 633/634 | L20S/E21G/C68R/E111R/E235S | ++ |
| 635/636 | C68R/D103S/D160S/E235S | + |
| 637/638 | L20G/E21G/C68R/V180A/E235S | + |
| 639/640 | L20G/E21G/V180A/S297A | + |
| 641/642 | L20S/E21G/D103S/P233G | + |
| 643/644 | L20G/C68R/D160S | + |
| 645/646 | L20S/E21G/C68R/D160S | + |
| 647/648 | C68R/D160S/P233G/L246G | + |
| 649/650 | E21G/C68R/D160S/E238G | + |
| 651/652 | E21G/D103S/P233G | + |
| 653/654 | C68R/E111R/P233G/D236N/S297A | + |
| 655/656 | L20S/D103S/P233G | + |
| 657/658 | E21G/P233G/S297A | + |
| 659/660 | L20S/E21G/E111R/S200R/E238G | + |
| 661/662 | L20S/E21G/E111R | + |
| 663/664 | L20S/E21G/C68R/D160S/L246G | + |
| 665/666 | E21G/C68R/D103S/E111R | + |
| 667/668 | L20G/E21G/P233G | + |
| 669/670 | D103S/D160S/S297A | + |
| 671/672 | E21G/C68R/E235S | + |
| 673/674 | C68R/S200A/E235S/S297A | + |
| 675/676 | E111R/D160S/P233G/E235S/S297A | + |
| 677/678 | D103S | + |
| 679/680 | L20G/C68R/D103S/D160S/S200R | + |
| 681/682 | E21G | + |
| 683/684 | L20S/E111R | + |
| 685/686 | E21G/C68R/D160S/V180A/S200R/D205A/S297A | + |
| 687/688 | L20S/E111R/V180A/E235S/L246G/S297A | + |
| 689/690 | L20S | + |

Levels of increased activity were determined relative to the reference polypeptide of SEQ ID NO: 4 and defined as follows: "+" 1.00 to 1.05, "++" >1.05, "+++" >1.15

Example 12

Improvements Over SEQ ID NO: 580 in the Extension of Oligonucleotide Acceptor Molecules with Nucleotide Triphosphate Donors HTP Screening for Improved TdT Variants SEQ ID NO: 580 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 12.1.

Reactions were performed in 96-well format 200 dL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 12.1. The quenched reactions were centrifuged at 4,000 rpm for 10 min at 4° C. to pellet any precipitate. Supernatant was then transferred into new HTP plates for analytical analysis as described in Table 12.1.

TABLE 12.1

| All lysis, purification, reaction, quench, and analytical properties |
|---|
| Lysis and purification conditions: Lysis buffer—20 mM Tris-HCl, pH 8, 300 mM NaCl, 0.2 g/L lysozyme from chicken egg white; Lysis buffer volume—400 μL; Lysate pre-treatment—Lysates were preincubated at 49° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide—2 μM TAATT; Nucleotide triphosphate—100 μM ddTTP; Reaction buffer—20 mM Tris-acetate, pH 8, 0.002 Unit/μL yeast pyrophosphatase (Thermo Scientific), 50 mM potassium acetate, 250 μM cobalt (II) chloride; Reaction volume—20 μL; Lysate dilution—None; Reaction temperature—49 °C.; Reaction time—60 minutes |
| Quench conditions: Quench solution and volume—Reactions were quenched by the addition of 24 μL acetonitrile. The solutions were mixed well and then further diluted by the addition of 16 μL of 20 mM aqueous EDTA.; Plate type and seal-96-well BioRad PCR plate with a plastic seal |
| Analytical conditions: Instrument—Agilent UHPLC 1260 prime series, Agilent Ultivo—see Example 4; Reaction product detected—TAATTddT |

Activity relative to SEQ ID NO: 580 (Activity FIOP) was calculated as the product peak area of the variant compared with the product peak area observed by the reaction with SEQ ID NO: 580 (where the peak area may be set as the average of replicates or else the highest single sample as appropriate). The results are shown in Table 12.2.

TABLE 12.2

| SEQ ID NO: (nt/aa) | Amino Acid Differences (Relative to SEQ ID NO: 580) | FIOP Product Peak Area Relative to SEQ ID NO: 580 |
|---|---|---|
| 691/692 | F67A/R87S/E111T/L157A/I315V | +++ |
| 693/694 | R87S/L157I/I315V | +++ |
| 695/696 | F67M/L157A/I315V | +++ |
| 697/698 | R87S/E111T/L157I/I315V | +++ |
| 699/700 | F67M/E106R/L157A | +++ |
| 701/702 | M55L/R87S/L157A | +++ |
| 703/704 | R87S/L157A | +++ |
| 705/706 | R87S/E111T/L157A/I315V | +++ |
| 707/708 | F67A/R87S/E106R/L157A | +++ |
| 709/710 | M55L/F67D/R87S/L1571/1315V | +++ |
| 711/712 | F67M/R87S/L157A | +++ |
| 713/714 | R87S/L157I | +++ |
| 715/716 | L157I | +++ |
| 717/718 | F67A/E111T | ++ |
| 719/720 | R87S | ++ |
| 721/722 | M55L/E106R/L157I | ++ |
| 723/724 | R87S/E106R | ++ |
| 725/726 | F67M/R87S/L157I | ++ |
| 727/728 | F67M/L157A | ++ |
| 729/730 | M55L/F67A/E106R/E111T/L157I | ++ |
| 731/732 | E106R/E111T/L157I | ++ |
| 733/734 | F67A/L157I | ++ |
| 735/736 | L1571/1315V | ++ |
| 737/738 | F67M/R87S | ++ |
| 739/740 | M55L/F67D/I315V | ++ |
| 741/742 | M55L/L157I | ++ |
| 743/744 | M55L/F67M/E106R/I315V | ++ |
| 745/746 | M55L/F67A/E111T/I315V | ++ |
| 747/748 | M55L/R87S/L157I | ++ |
| 749/750 | L157A | ++ |
| 751/752 | E106R/I315V | ++ |
| 753/754 | M55L/F67A/E111T | + |
| 755/756 | M55L/F67N/R87S | + |
| 757/758 | F67N/R87S/I315V | + |
| 759/760 | M55L/F67N/R87S/E106R/E111T/I315V | + |
| 761/762 | I315V | + |
| 763/764 | F67A/E106R/E111T/I315V | + |
| 765/766 | F67M/E111T/I315V | + |
| 767/768 | F67M | + |
| 769/770 | M55L/F67D | + |
| 771/772 | F67N/E106R | + |
| 773/774 | F67D | + |
| 775/776 | M55L/I315V | + |
| 777/778 | M55L/R87S/E106R/I315V | + |
| 779/780 | F67N | + |
| 781/782 | M55L/F67M/R87S | + |
| 783/784 | M55L/R87S/E106R/E111T/I315V | + |
| 785/786 | M55L/E106R/E111T | + |
| 787/788 | F67N/E106R/E111T | + |
| 789/790 | M55L/R87S | + |

TABLE 12.2-continued

| SEQ ID NO: (nt/aa) | Amino Acid Differences (Relative to SEQ ID NO: 580) | FIOP Product Peak Area Relative to SEQ ID NO: 580 |
|---|---|---|
| 791/792 | M55L/E111T | + |
| 793/794 | F67D/E111T | + |
| 795/796 | M55L/E111T/I315V | + |
| 797/798 | M55L/R87S/E106R | + |
| 799/800 | F67N/R87S | + |
| 801/802 | M55L/R87S/L157I/L207Q | + |
| 803/804 | E106R | + |
| 805/806 | F67A | + |
| 807/808 | R87S/E106R/E111T/I315V | + |
| 809/810 | R87S/I315V | + |
| 811/812 | M55L | + |

Levels of increased activity were determined relative to the reference polypeptide of SEQ ID NO: 580 and defined as follows: "+" 2.24 to 3.50, "++" >3.50, "+++" >4.75

Example 13

Improvements Over SEQ ID NO: 580 in the Extension of Oligonucleotide Acceptor Molecules with Nucleotide Triphosphate Donors HTP Screening for Improved TdT Variants SEQ ID NO: 580 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 13.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 13.1. The quenched reactions were centrifuged at 4,000 rpm for 10 min at 4° C. to pellet any precipitate. Supernatant was then transferred into new HTP plates for analytical analysis as described in Table 13.1.

TABLE 13.1

| All lysis, purification, reaction, quench, and analytical properties |
|---|
| Lysis and purification conditions: Lysis buffer—20 mM Tris-HCl, pH 8, 100 mM NaCl, 0.2 g/L lysozyme from chicken egg white; Lysis buffer volume—400 μL; Lysate pre-treatment—Lysates were preincubated at 49° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide—2 μM TAATT; Nucleotide triphosphate—100 μM ddTTP; Reaction buffer—20 mM Tris-acetate, pH 8, 0.002 Unit/μL yeast pyrophosphatase (Thermo Scientific), 50 mM potassium acetate, 250 μM cobalt (II) chloride; Reaction volume—20 μL; Lysate dilution—None; Reaction temperature—49° C.; Reaction time—60 minutes |
| Quench conditions: Quench solution and volume—Reactions were quenched by the addition of 24 μL acetonitrile. The solutions were mixed well and then further diluted by the addition of 16 μL of 20 mM aqueous EDTA.; Plate type and seal-96-well BioRad PCR plate with a plastic seal |
| Analytical conditions: Instrument—Agilent UHPLC 1260 prime series, Agilent Ultivo—see Example 4; Reaction product detected—TAATTddT |

Activity relative to SEQ ID NO: 580 (Activity FIOP) was calculated as the product peak area of the variant compared with the product peak area observed by the reaction with SEQ ID NO: 580 (where the peak area may be set as the average of replicates or else the highest single sample as appropriate). The results are shown in Table 13.2.

TABLE 13.2

| SEQ ID NO: (nt/aa) | Amino Acid Differences (Relative to SEQ ID NO: 580) | FIOP Product Peak Area Relative to SEQ ID NO: 580 |
|---|---|---|
| 813/814 | K62N/R68C/E111Y | +++ |
| 815/816 | E111Y | +++ |
| 817/818 | F147Y/I210L/K234G | +++ |
| 819/820 | K62N/E63G/R68C/I91L/1109L/I210L | ++ |
| 821/822 | K62N/E63G/R68C | ++ |
| 823/824 | E60V/K62N/R68C/I91L/E111Y/K234G/Y289P | ++ |
| 825/826 | K62N/E63G/R68C/I91L/F147Y/D205G/I210L/K234G | ++ |
| 827/828 | I109L/E111Y/D205G/I210L/K234G/Y289P | ++ |
| 829/830 | Y59A/K62N/E63G/R68C | ++ |
| 831/832 | K62N/R68C/I91L/E111Y/Y289P | + |
| 833/834 | I91L | + |
| 835/836 | Y59A/K62N/E63G/R68C/D103R/K234G | + |
| 837/838 | I91L/1109L/F147Y/D205G/I210L/K234G | + |
| 839/840 | Y59A/K62N/E63G/R68C/F147Y | + |

TABLE 13.2-continued

| SEQ ID NO: (nt/aa) | Amino Acid Differences (Relative to SEQ ID NO: 580) | FIOP Product Peak Area Relative to SEQ ID NO: 580 |
|---|---|---|
| 841/842 | K62N/R68C/D103R | + |
| 843/844 | I91L/I109L/E111Y | + |

Levels of increased activity were determined relative to the reference polypeptide of SEQ ID NO: 580 and defined as follows: "+" 1.23 to 1.50, "++" >1.50, "+++" >2.00

Example 14

Improvements Over SEQ ID NO: 692 in the Extension of Oligonucleotide Acceptor Molecules with Nucleotide Triphosphate Donors HTP Screening for Improved TdT Variants SEQ ID NO: 692 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 14.1.

Reactions were performed in 96-well format 200 dL BioRad PCR plates. Reactions included 1-4 µM oligonucleotide, 25-200 µM nucleotide triphosphate, 0.002 Unit/µL yeast pyrophosphatase (Thermo Scientific), 20 mM buffer, 50 mM potassium acetate, and 250 µM cobalt (II) chloride. The reactions were set up as follows: (i) all reaction components, except for TdT, were pre-mixed in a single solution, and 15 µL of this solution was aliquoted into each well of the 96-well plates (ii) 5 µL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 14.1. The quenched reactions were centrifuged at 4,000 rpm for 10 mdi at 4° C. to pellet any precipitate. Supernatant was then transferred into new HTP plates for analytical analysis as described in Table 14.1.

TABLE 14.1

| All lysis, purification, reaction, quench, and analytical properties |
|---|
| Lysis and purification conditions: Lysis buffer—20 mM Tris-HCl, pH 8, 100 mM NaCl, 0.2 g/L lysozyme from chicken egg white; Lysis buffer volume—400 µL; Lysate pre-treatment—Lysates were preincubated at 55° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide—2 µM TAATT; Nucleotide triphosphate—50 µM ddTTP; Reaction buffer—20 mM Tris-acetate, pH 8, 0.002 Unit/µL yeast pyrophosphatase (Thermo Scientific), 50 mM potassium acetate, 250 µM cobalt (II) chloride; Reaction volume—20 µL; Lysate dilution—None; Reaction temperature—55° C.; Reaction time—15 minutes |
| Quench conditions: Quench solution and volume—Reactions were quenched by the addition of 24 µL acetonitrile. The solutions were mixed well and then further diluted by the addition of 16 µL of 20 mM aqueous EDTA.; Plate type and seal-96-well BioRad PCR plate with a plastic seal |
| Analytical conditions: Instrument—Agilent UHPLC 1260 prime series, Agilent Ultivo—see Example 4; Reaction product detected—TAATTddT |

Activity relative to SEQ ID NO: 692 (Activity FIOP) was calculated as the product peak area of the variant compared with the product peak area observed by the reaction with SEQ ID NO: 692 (where the peak area may be set as the average of replicates or else the highest single sample as appropriate). The results are shown in Table 14.2.

TABLE 14.2

| SEQ ID NO: (nt/aa) | Amino Acid Differences (Relative to SEQ ID NO: 692) | FIOP Product Peak Area Relative to SEQ ID NO: 692 |
|---|---|---|
| 845/846 | M55L/D99P/C256G/H350V | +++ |
| 847/848 | M55L/S181R/E235Q/C256E/H350V | +++ |
| 849/850 | F52L/D99P/S181R/E235Q | +++ |
| 851/852 | E235Q | +++ |
| 853/854 | F52L/E106R/C256E | ++ |
| 855/856 | F52L/E106R/S181R/E235Q/C256G | ++ |
| 857/858 | F173L | ++ |
| 859/860 | F52L/M55L/E106R/C256G | ++ |
| 861/862 | F52L/F173L/E235Q | ++ |
| 863/864 | F52L/M55L/S181R/C256G | ++ |
| 865/866 | F52L/E235Q | ++ |
| 867/868 | D99P/E235Q | + |
| 869/870 | M55L/D99P/S181R/C256G | + |
| 871/872 | F52L/E235Q/C256E | + |
| 873/874 | F52L/M55L/S181R/E235Q/C256E | + |
| 875/876 | E106R | + |
| 877/878 | F52L/E106R/E235Q/C256G | + |
| 879/880 | M55L/C256G | + |

Levels of increased activity were determined relative to the reference polypeptide of SEQ ID NO: 692 and defined as follows: "+" 1.32 to 1.50, "++" >1.50, "+++" >1.75

Example 15

Improvements Over SEQ ID NO: 4 in the Extension of Oligonucleotide Acceptor Molecules with Nucleotide Triphosphate Donors HTP Screening for Improved TdT Variants SEQ ID NO: 4 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 15.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 15.1. The quenched reactions were centrifuged at 4,000 rpm for 10 min at 4° C. to pellet any precipitate. Supernatant was then transferred into new HTP plates for analytical analysis as described in Table 15.1.

TABLE 15.1

| All lysis, purification, reaction, quench, and analytical properties |
|---|
| Lysis and purification conditions; Lysis buffer-50 mM Tris buffer, pH 8.0, 75% (v/v) B-Per reagent (Thermo Fisher), 0.2 mg/ml lysozyme, 300 mM NaCl, 10 mM imidazole, and 0.2% (v/v) Triton X-100; Lysis buffer volume-300 μL; Lysate pre-treatment-Lysates were processed at 25° C., then centrifuged at 4,000 rpm for 10 min as described in Example 2 [Lysis of HTP Cell Pellets for HTP Purification of TdT from Crude Lysate]. The HTP purified enzymes were used in reactions. |
| Reaction conditions: Oligonucleotide-4 μM TTTTTTTATC; Nucleotide triphosphate-200 μM 3'PO4-dCTP; Reaction buffer-20 mM Tris-acetate, pH 8, 0.002 Unit/μL yeast pyrophosphatase (Thermo Scientific), 50 mM potassium acetate, 250 μM cobalt (II) chloride; Reaction volume-20 μL; Lysate dilution-None; Reaction temperature-40° C.; Reaction time-180 minutes |
| Quench conditions: Quench solution and volume-Reactions were quenched by the addition of 24 μL acetonitrile. The solutions were mixed well and then further diluted by the addition of 16 μL of 20 mM aqueous EDTA.; Plate type and seal-96-well BioRad PCR plate with a plastic seal |
| Analytical conditions: Instrument-Agilent UHPLC 1260 prime series, Agilent Ultivo-see Example 4; Reaction product detected-TTTTTTTATCC-3'PO4 |

Activity relative to SEQ ID NO: 4 (Activity FIOP) was calculated as the product peak area of the variant compared with the product peak area observed by the reaction with SEQ ID NO: 4 (where the peak area may be set as the average of replicates or else the highest single sample as appropriate). The results are shown in Table 15.2.

TABLE 15.2

| SEQ ID NO: (nt/aa) | Amino Acid Differences (Relative to SEQ ID NO: 4) | FIOP Product Peak Area Relative to SEQ ID NO: 4 |
|---|---|---|
| 881/882 | L20G/E21G/E60K/L72K/D160S/V180A/S200R/L246G/I259K/R338K/N358R | +++ |
| 851/852 | L20G/E21G/F67A/C68R/R87S/E111T/L157A/D160S/VI80A/S200R/E235Q/L246G/I315V | +++ |
| 861/862 | L20G/E21G/F52L/F67A/C68R/R87S/E111T/L157A/D160S/F173L/V180A/S200R/E235Q/L246G/I315V | ++ |
| 847/848 | L20G/E21G/M55L/F67A/C68R/R87S/E111T/L157A/D160S/V180A/S181R/S200R/E235Q/L246G/C256E/I315V/H350V | ++ |
| 883/884 | L20G/E21G/F67A/C68R/R87S/E111T/L157A/D160S/VI80A/S200R/L246G/I315V | + |
| 879/880 | L20G/E21G/M55L/F67A/C68R/R87S/E111T/L157A/D160S/V180A/S200R/L246G/C256G/I315V | + |
| 579/580 | L20G/E21G/C68R/D160S/V180A/S200R/L246G | + |

Levels of increased activity were determined relative to the reference polypeptide of SEQ ID NO: 4 and defined as follows: "+" 1.00 to 5.00, "++" >5.00, "+++" >8.00

Example 16

Improvements Over SEQ ID NO: 882 in the Extension of Oligonucleotide Acceptor Molecules with Nucleotide Triphosphate Donors HTP Screening for Improved TdT Variants SEQ ID NO: 882 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 16.1.

Reactions were performed in 96-well format 200 L BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) S μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 16.1. The quenched reactions were centrifuged at 4,000 rpm for 10 min at 4° C. to pellet any precipitate. Supernatant was then transferred into new HTP plates for analytical analysis as described in Table 16.1.

TABLE 16.1

| All lysis, purification, reaction, quench, and analytical properties |
|---|
| Lysis and purification conditions; Lysis buffer-50 mM Tris buffer, pH 8.0, 75% (v/v) B-Per reagent (Thermo Fisher), 0.2 mg/ml lysozyme, 300 mM NaCl, 10 mM imidazole, and 0.2% (v/v) Triton X-100; Lysis buffer volume-300 μL; Lysate pre-treatment-Lysates were processed at 25° C., then centrifuged at 4,000 rpm for 10 min as described in Example 2 [Lysis of HTP Cell Pellets for HTP Purification of TdT from Crude Lysate]. The HTP purified enzymes were used in reactions. |
| Reaction conditions: Oligonucleotide-4 μM TTTTTTTATC; Nucleotide triphosphate-200 μM |

TABLE 16.1-continued

| All lysis, purification, reaction, quench, and analytical properties |
|---|
| 3'PO4-dCTP; Reaction buffer-20 mM Tris-acetate, pH 8, 0.002 Unit/μL yeast pyrophosphatase (Thermo Scientific), 50 mM potassium acetate, 250 μM cobalt (II) chloride; Reaction volume-20 μL; Lysate dilution-None; Reaction temperature-40° C.; Reaction time-180 minutes |
| Quench conditions: Quench solution and volume-Reactions were quenched by the addition of 24 μL acetonitrile. The solutions were mixed well and then further diluted by the addition of 16 μL of 20 mM aqueous EDTA.; Plate type and seal-96-well BioRad PCR plate with a plastic seal |
| Analytical conditions: Instrument-Agilent UHPLC 1260 prime series, Agilent Ultivo-see Example 4; Reaction product detected-TTTTTTTATCC-3'PO4 |

Activity relative to SEQ ID NO: 882 (Activity FIOP) was calculated as the product peak area of the variant compared with the product peak area observed by the reaction with SEQ ID NO: 882 (where the peak area may be set as the average of replicates or else the highest single sample as appropriate). The results are shown in Table 16.2.

TABLE 16.2

| SEQ ID NO: (nt/aa) | Amino Acid Differences (Relative to SEQ ID NO: 882) | FIOP Product Peak Area Relative to SEQ ID NO: 882 |
|---|---|---|
| 885/886 | S349E | +++ |
| 887/888 | T211C | +++ |
| 889/890 | E63G | +++ |
| 891/892 | K72R | ++ |
| 893/894 | S349M | ++ |
| 895/896 | H350Y | + |
| 897/898 | A275R | + |
| 899/900 | C68M | + |
| 901/902 | S349R | + |
| 903/904 | H350E | + |
| 905/906 | M220R | + |

Levels of increased activity were determined relative to the reference polypeptide of SEQ ID NO: 882 and defined as follows: "+" 1.31 to 2.00, "++" >2.00, "+++" >3.00

Example 17

Improvements Over SEQ ID NO: 882 in the Extension of Oligonucleotide Acceptor Molecules with Nucleotide Triphosphate Donors HTP Screening for Improved TdT Variants SEQ ID NO: 882 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 17.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 17.1. The quenched reactions were centrifuged at 4,000 rpm for 10 min at 4° C. to pellet any precipitate. Supernatant was then transferred into new HTP plates for analytical analysis as described in Table 17.1.

TABLE 17.1

| All lysis, purification, reaction, quench, and analytical properties |
|---|
| Lysis and purification conditions; Lysis buffer-50 mM Tris buffer, pH 8.0, 75% (v/v) B-Per reagent (Thermo Fisher), 0.2 mg/ml lysozyme, 300 mM NaCl, 10 mM imidazole, and 0.2% (v/v) Triton X-100; Lysis buffer volume-300 μL; Lysate pre-treatment-Lysates were processed at 25° C., then centrifuged at 4,000 rpm for 10 min as described in Example 2 [Lysis of HTP Cell Pellets for HTP Purification of TdT from Crude Lysate]. The HTP purified enzymes were used in reactions. |
| Reaction conditions: Oligonucleotide-4 μM TTTTTTTATC; Nucleotide triphosphate-200 μM 3'PO4-dCTP; Reaction buffer-20 mM Tris-acetate, pH 8, 0.002 Unit/μL yeast pyrophosphatase (Thermo Scientific), 50 mM potassium acetate, 250 μM cobalt (II) chloride; Reaction volume-20 μL; Lysate dilution-None; Reaction temperature-40° C.; Reaction time-180 minutes |
| Quench conditions: Quench solution and volume-Reactions were quenched by the addition of 24 μL acetonitrile. The solutions were mixed well and then further diluted by the addition of 16 μL of 20 mM aqueous EDTA.; Plate type and seal-96-well BioRad PCR plate with a plastic seal |
| Analytical conditions: Instrument-Agilent UHPLC 1260 prime series, Agilent Ultivo-see Example 4; Reaction product detected-TTTTTTTATCC-3'PO4 |

Activity relative to SEQ ID NO: 882 (Activity FIOP) was calculated as the product peak area of the variant compared with the product peak area observed by the reaction with SEQ ID NO: 882 (where the peak area may be set as the average of replicates or else the highest single sample as appropriate). The results are shown in Table 17.2.

TABLE 17.2

| SEQ ID NO: (nt/aa) | Amino Acid Differences (Relative to SEQ ID NO: 882) | FIOP Product Peak Area Relative to SEQ ID NO: 882 |
|---|---|---|
| 907/908 | G21E/F67A/A180V/I315V | +++ |
| 909/910 | R87S/L157A | +++ |
| 911/912 | I315V | +++ |
| 913/914 | G21E/F67A/R87S/L157A/G246L | +++ |
| 915/916 | R87S/E111T/R200S | +++ |
| 917/918 | F67A/A180V/R200S/I315V | +++ |
| 919/920 | F67A/R87S | +++ |
| 921/922 | F67A/L157A/S160D/A180V | +++ |
| 923/924 | F67A/E111T | +++ |
| 925/926 | G21E/S160D/I315V | +++ |
| 927/928 | G21E/R87S/G246L/I315V | +++ |
| 929/930 | G21E | +++ |
| 931/932 | G20L/G21E/R87S/A180V/G246L/I315V | +++ |
| 933/934 | G20L/G21E/F67A/S160D | +++ |
| 935/936 | L157A/S160D | ++ |
| 937/938 | R87S/E111T/R200S/G246L | ++ |
| 939/940 | F67A/R87S/E111T/L157A/S160D/I315V | ++ |
| 941/942 | G20L/G21E/E111T/G246L | ++ |
| 943/944 | G20L/G21E/R87S/E111T/G246L/I315V | ++ |
| 945/946 | G20L/G21E/F67A/R87S/E111T/R200S | ++ |
| 947/948 | G21E/R87S/S160D/I315V | ++ |
| 949/950 | F67A/A180V/R200S | ++ |
| 951/952 | G21E/R87S/L157A/S160D | ++ |
| 953/954 | G246L | ++ |

TABLE 17.2-continued

| SEQ ID NO: (nt/aa) | Amino Acid Differences (Relative to SEQ ID NO: 882) | FIOP Product Peak Area Relative to SEQ ID NO: 882 |
|---|---|---|
| 955/956 | G20L/R87S/E111T/A180V | ++ |
| 957/958 | L157A | ++ |
| 959/960 | R87S/L157A/A180V/R200S | ++ |
| 961/962 | G21E/E111T | ++ |
| 963/964 | F67A/L157A/S160D/I315V | ++ |
| 965/966 | G20L/R200S | ++ |
| 967/968 | E111T/L157A/A180V/R200S/I315V | ++ |
| 969/970 | G21E/R200S/I315V | ++ |
| 971/972 | G20L/G21E/F67A/R87S/L157A/A180V | ++ |
| 973/974 | F67A/S160D | ++ |
| 975/976 | G20L/F67A/R87S/L157A/S160D/A180V/I315V | + |
| 977/978 | G21E/F67A/R87S/E111T/R200S | + |
| 979/980 | G20L/C68R/S160D/R200S/G246L | + |
| 981/982 | G20L/G21E/R87S/I315V | + |
| 983/984 | G20L/C68R/E111T/L157A/S160D | + |
| 985/986 | G20L/G21E/I315V | + |
| 987/988 | G20L/G21E/E111T/L157A/I315V | + |
| 989/990 | G21E/G246L | + |
| 991/992 | G20L/F67A/R87S/E111T/A180V | + |
| 993/994 | G20L/G21E | + |
| 995/996 | F67A/I315V | + |
| 997/998 | G20L/G21E/F67A/R87S/E111T/I315V | + |
| 999/1000 | G21E/R87S/S160D/R200S/I315V | + |
| 1001/1002 | C68R/L157A/S160D/R200S/I315V | + |
| 1003/1004 | G20L/G21E/F67A | + |
| 1005/1006 | G20L/G21E/F67A/R87S | + |
| 1007/1008 | G21E/L157A/S160D | + |
| 1009/1010 | R87S/E111T | + |
| 1011/1012 | G20L/G21E/F67A/R87S/E111T | + |
| 1013/1014 | G20L/S160D/I315V | + |
| 1015/1016 | C68R/R87S | + |
| 1017/1018 | G20L/G21E/F67A/R87S/G246L/I315V | + |
| 1019/1020 | G20L/G21E/R87S/L157A/R200S | + |
| 1021/1022 | G21E/F67A/R200S | + |
| 1023/1024 | G21E/R87S/R200S | + |
| 1025/1026 | F67A | + |
| 1027/1028 | G20L/R87S/L157A/S160D | + |
| 1029/1030 | R87S | + |

Levels of increased activity were determined relative to the reference polypeptide of SEQ ID NO: 882 and defined as follows: "+" 1.27 to 1.75, "++" >1.75, "+++" >2.50

Example 18

Improvements Over SEQ ID NO: 914 in the Extension of Oligonucleotide Acceptor Molecules with Nucleotide Triphosphate Donors HTP Screening for Improved TdT Variants SEQ ID NO: 914 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 18.1.

Reactions were performed in 96-well format 200 L Bio-Rad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 L of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 18.1. The quenched reactions were centrifuged at 4,000 rpm for 10 min at 4° C. to pellet any precipitate. Supernatant was then transferred into new HTP plates for analytical analysis as described in Table 18.1.

TABLE 18.1

| All lysis, purification, reaction, quench, and analytical properties |
|---|
| Lysis and purification conditions; Lysis buffer-50 mM Tris buffer, pH 8.0, 75% (v/v) B-Per reagent (Thermo Fisher), 0.2 mg/ml lysozyme, 300 mM NaCl, 10 mM imidazole, and 0.2% (v/v) Triton X-100; Lysis buffer volume-300 μL; Lysate pre-treatment-Lysates were processed at 25° C., then centrifuged at 4,000 rpm for 10 min as described in Example 2 [Lysis of HTP Cell Pellets for HTP Purification of TdT from Crude Lysate]. The HTP purified enzymes were used in reactions. |
| Reaction conditions: Oligonucleotide-4 μM TTTTTTTATC; Nucleotide triphosphate-150 μM 3'PO4-dCTP; Reaction buffer-20 mM Tris-acetate, pH 8, 0.002 Unit/μL yeast pyrophosphatase (Thermo Scientific), 50 mM potassium acetate, 250 μM cobalt (II) chloride; Reaction volume-20 μL; Lysate dilution-None; Reaction temperature-40° C.; Reaction time-90 minutes |
| Quench conditions: Quench solution and volume-Reactions were quenched by the addition of 24 μL acetonitrile. The solutions were mixed well and then further diluted by the addition of 16 μL of 20 mM aqueous EDTA.; Plate type and seal-96-well BioRad PCR plate with a plastic seal |
| Analytical conditions: Instrument-Agilent UHPLC 1260 prime series, Agilent Ultivo-see Example 4; Reaction product detected-TTTTTTTATCC-3'PO4 |

Activity relative to SEQ ID NO: 914 (Activity FIOP) was calculated as the product peak area of the variant compared with the product peak area observed by the reaction with SEQ ID NO: 914 (where the peak area may be set as the average of replicates or else the highest single sample as appropriate). The results are shown in Table 18.2.

TABLE 18.2

| SEQ ID NO: (nt/aa) | Amino Acid Differences (Relative to SEQ ID NO: 914) | FIOP Product Peak Area Relative to SEQ ID NO: 914 |
|---|---|---|
| 1031/1032 | F52L/S349E | +++ |
| 1033/1034 | F52L/S349E/H350E | +++ |
| 1035/1036 | F52L/A180V/R200S/E235Q/I315V/S349E | +++ |
| 1037/1038 | F52L/A180V/S349E | ++ |
| 1039/1040 | F52L/R200S/S349E/H350E | ++ |
| 1041/1042 | S349E | ++ |
| 1043/1044 | F52L/A180V/R200S/S349E | ++ |
| 1045/1046 | F52L/A180V | + |
| 1047/1048 | F52L/R200S | + |
| 1049/1050 | F52L/I315V/S349E | + |
| 1051/1052 | F52L/R200S/I315V | + |
| 1053/1054 | F52L/R200S/S349E | + |
| 1055/1056 | F52L/I315V | + |
| 1057/1058 | F52L | + |
| 1059/1060 | A180V | + |

Levels of increased activity were determined relative to the reference poLypeptide of SEQ ID NO: 914 and defined as follows: "+" 1.63 to 2.75, "++" >2.75, "+++" >4.00

Example 19

Improvements Over SEQ ID NO: 1034 in the Extension of Oligonucleotide Acceptor Molecules with Nucleotide Triphosphate Donors HTP Screening for Improved TdT Variants SEQ ID NO: 1034 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 19.1.

Reactions were performed in 96-well format 200 L Bio-Rad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 19.1. The quenched reactions were centrifuged at 4,000 rpm for 10 min at 4° C. to pellet any precipitate. Supernatant was then transferred into new HTP plates for analytical analysis as described in Table 19.1.

TABLE 19.1

| All lysis, purification, reaction, quench, and analytical properties |
|---|
| Lysis and purification conditions; Lysis buffer-50 mM Tris buffer, pH 8.0, 75% (v/v) B-Per reagent (Thermo Fisher), 0.2 mg/ml lysozyme, 300 mM NaCl, 10 mM imidazole, and 0.2% (v/v) Triton X-100; Lysis buffer volume-300 μL; Lysate pre-treatment-Lysates were preincubated at 42° C., then centrifuged at 4,000 rpm for 10 min as described in Example 2 [Lysis of HTP Cell Pellets for HTP Purification of TdT from Crude Lysate]. The HTP purified enzymes were used in reactions. |
| Reaction conditions: Oligonucleotide-4 uM TTTTTTTATC; Nucleotide triphosphate-100 μM 3'PO4-dCTP; Reaction buffer-20 mM Tris-acetate, pH 8, 0.002 Unit/μL yeast pyrophosphatase (Thermo Scientific), 50 mM potassium acetate, 250 uM cobalt (II) chloride; Reaction volume-20 μL; Lysate dilution-None; Reaction temperature-42° C.; Reaction time-60 minutes |
| Quench conditions: Quench solution and volume-Reactions were quenched by the addition of 24 μL acetonitrile. The solutions were mixed well and then further diluted by the addition of 16 μL of 20 mM aqueous EDTA.; Plate type and seal-96-well BioRad PCR plate with a plastic seal |
| Analytical conditions: Instrument-Agilent UHPLC 1260 prime series, Agilent Ultivo-see Example 4; Reaction product detected-TTTTTTTATCC-3'PO4 |

Activity relative to SEQ ID NO: 1034 (Activity FIOP) was calculated as the product peak area of the variant compared with the product peak area observed by the reaction with SEQ ID NO: 1034 (where the peak area may be set as the average of replicates or else the highest single sample as appropriate). The results are shown in Table 19.2.

TABLE 19.2

| SEQ ID NO: (nt/aa) | Amino Acid Differences (Relative to SEQ ID NO: 1034) | FIOP Product Peak Area Relative to SEQ ID NO: 1034 |
|---|---|---|
| 1061/1062 | E53Q/K219P/R358N | +++ |
| 1063/1064 | M55L/K219P/L246G/R358N | +++ |
| 1065/1066 | K219P/R358N | +++ |
| 1067/1068 | R358N | +++ |
| 1069/1070 | M55L/D99P/K219P/R358N/G373D | +++ |
| 1071/1072 | D103A/K219P/K338R/R358N | +++ |
| 1073/1074 | E111T/F173L | +++ |
| 1075/1076 | E111T/F173L/E235Q/I315V | ++ |
| 1077/1078 | M55L/K219P/C256G/K338R | ++ |
| 1079/1080 | M55L/S181R/R358N | ++ |
| 1081/1082 | M55L | ++ |
| 1083/1084 | F173L/S297A | ++ |
| 1085/1086 | M55L/D99P/D103A | ++ |
| 1087/1088 | D103A/K259I | ++ |
| 1089/1090 | M55L/D103A/K219P | ++ |
| 1091/1092 | C256G/K259I | ++ |
| 1093/1094 | M55L/S181R/K219P | ++ |
| 1095/1096 | M55L/S181R/L246G | + |
| 1097/1098 | D103A/K219P/C256E | + |
| 1099/1100 | E106R/F173L/R200S/E235Q/I315V | + |
| 1101/1102 | S181R | + |
| 1103/1104 | M55L/C256G/K259I | + |
| 1105/1106 | E106R/F173L/E388Q | + |
| 1107/1108 | C256E | + |
| 1109/1110 | D103A/C256G | + |
| 1111/1112 | F173L | + |
| 1113/1114 | D99P/D103A/K219P | + |
| 1115/1116 | M55L/D103A/K338R | + |
| 1117/1118 | C256G | + |
| 1119/1120 | M55L/D103A/S181R | + |
| 1121/1122 | K219P | + |

Levels of increased activity were determined relative to the reference polypeptide of SEQ ID NO: 1034 and defined as follows: "+" 1.14 to 1.50, "++" >1.50, "+++" >3.00

Example 20

Improvements Over SEQ ID NO: 1034 in the Extension of Oligonucleotide Acceptor Molecules with Nucleotide Triphosphate Donors HTP Screening for Improved TdT Variants SEQ ID NO: 1034 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 20.1.

Reactions were performed in 96-well format 200 L Bio-Rad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 20.1. The quenched reactions were centrifuged at 4,000 rpm for 10 min at 4° C. to pellet any precipitate. Supernatant was then transferred into new HTP plates for analytical analysis as described in Table 20.1.

TABLE 20.1

| All lysis, purification, reaction, quench, and analytical properties |
|---|
| Lysis and purification conditions; Lysis buffer-50 mM Tris buffer, pH 8.0, 75% (v/v) B-Per reagent (Thermo Fisher), 0.2 mg/ml lysozyme, 300 mM NaCl, 10 mM imidazole, and 0.2% (v/v) Triton X-100; Lysis buffer volume-325 µL; Lysate pre-treatment-Lysates were processed at 25° C., then centrifuged at 4,000 rpm for 10 min as described in Example 2 [Lysis of HTP Cell Pellets for HTP Purification of TdT from Crude Lysate]. The HTP purified enzymes were used in reactions. |
| Reaction conditions: Oligonucleotide-4 µM TTTTTTTATC; Nucleotide triphosphate-50 uM 3'PO4-dTTP; Reaction buffer-20 mM Tris-acetate, pH 8, 0.002 Unit/µL yeast pyrophosphatase (Thermo Scientific), 50 mM potassium acetate, 250 µM cobalt (II) chloride; Reaction volume-20 µL; Lysate dilution-None; Reaction temperature-42° C.; Reaction time-60 minutes |
| Quench conditions: Quench solution and volume-Reactions were quenched by the addition of 24 µL acetonitrile. The solutions were mixed well and then further diluted by the addition of 16 µL of 20 mM aqueous EDTA.; Plate type and seal-96-well BioRad PCR plate with a plastic seal |
| Analytical conditions: Instrument-Agilent UHPLC 1260 prime series, Agilent Ultivo-see Example 4; Reaction product detected-TTTTTTTATCT-3'PO4 |

Activity relative to SEQ ID NO: 1034 (Activity FIOP) was calculated as the product peak area of the variant compared with the product peak area observed by the reaction with SEQ ID NO: 1034 (where the peak area may be set as the average of replicates or else the highest single sample as appropriate). The results are shown in Table 20.2.

TABLE 20.2

| SEQ ID NO: (nt/aa) | Amino Acid Differences (Relative to SEQ ID NO: 1034) | FIOP Product Peak Area Relative to SEQ ID NO: 1034 |
|---|---|---|
| 1123/1124 | E65L | +++ |
| 1061/1062 | E53Q/K219P/R358N | +++ |
| 1069/1070 | M55L/D99P/K219P/R358N/G373D | +++ |
| 1065/1066 | K219P/R358N | +++ |
| 1125/1126 | I355V | +++ |
| 1127/1128 | K219L | ++ |
| 1067/1068 | R358N | ++ |
| 1129/1130 | L77V | ++ |
| 1079/1080 | M55L/S181R/R358N | ++ |
| 1131/1132 | I66S | ++ |
| 1133/1134 | E70V | ++ |
| 1135/1136 | L77I | ++ |
| 1137/1138 | N58D | ++ |
| 1139/1140 | F71A | ++ |
| 1071/1072 | D103A/K219P/K338R/R358N | ++ |
| 1141/1142 | L78F | + |
| 1063/1064 | M55L/K219P/L246G/R358N | + |
| 1143/1144 | A74G | + |
| 1145/1146 | A328F | + |
| 1147/1148 | K79R | + |
| 1149/1150 | K219V | + |
| 1151/1152 | M55L/C256E | + |
| 1153/1154 | A56V | + |
| 1155/1156 | L52A | + |
| 1157/1158 | K62G | + |
| 1159/1160 | I66P | + |
| 1161/1162 | F48T | + |
| 1081/1082 | M55L | + |
| 1163/1164 | K353S | + |
| 1165/1166 | E350T | + |
| 1167/1168 | R345V | + |

Levels of increased activity were determined relative to the reference polypeptide of SEQ ID NO: 1034 and defined as follows: "+" 1.16 to 1.50, "++" >1.50, "+++" >2.00

Example 21

Improvements Over SEQ ID NO: 1034 in the Extension of Oligonucleotide Acceptor Molecules with Nucleotide Triphosphate Donors

HTP Screening for Improved TdT Variants

SEQ ID NO: 1034 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 21.1.

Reactions were performed in 96-well format 200 µL BioRad PCR plates. Reactions included 1-4 µM oligonucleotide, 25-200 µM nucleotide triphosphate, 0.002 Unit/µL yeast pyrophosphatase (Thermo Scientific), 20 mM buffer, 50 mM potassium acetate, and 250 µM cobalt (II) chloride. The reactions were set up as follows: (i) all reaction components, except for TdT, were pre-mixed in a single solution, and 15 µL of this solution was aliquoted into each well of the 96-well plates (ii) 5 µL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 21.1. The quenched reactions were centrifuged at 4,000 rpm for 10 min at 4° C. to pellet any precipitate. Supernatant was then transferred into new HTP plates for analytical analysis as described in Table 21.1.

TABLE 21.1

| All lysis, purification, reaction, quench, and analytical properties |
|---|
| Lysis and purification conditions; Lysis buffer-50 mM Tris buffer, pH 8.0, 75% (v/v) B-Per reagent (Thermo Fisher), 0.2 mg/ml lysozyme, 300 mM NaCl, 10 mM imidazole, and 0.2% (v/v) Triton X-100; Lysis buffer volume-325 µL; Lysate pre-treatment-Lysates were processed at 25° C., then centrifuged at 4,000 rpm for 10 min as described in Example 2 [Lysis of HTP Cell Pellets for HTP Purification of TdT from Crude Lysate]. The HTP purified enzymes were used in reactions. |
| Reaction conditions: Oligonucleotide-4 µM TTTTTTTATC; Nucleotide triphosphate-50 uM 3'PO4-dTTP; Reaction buffer-20 mM Tris-acetate, pH 8, 0.002 Unit/µL yeast pyrophosphatase (Thermo Scientific), 50 mM potassium acetate, 250 µM cobalt (II) chloride; Reaction volume-20 µL; Lysate dilution-None; Reaction temperature-42° C.; Reaction time-60 minutes |
| Quench conditions: Quench solution and volume-Reactions were quenched by the addition of 24 µL acetonitrile. The solutions were mixed well and then further diluted by the addition of 16 µL of 20 mM aqueous EDTA.; Plate type and seal-96-well BioRad PCR plate with a plastic seal |
| Analytical conditions: Instrument-Thermo Accela, Thermo LTQ XL-see Example 5; Reaction product detected-TTTTTTTATCT-3'PO4 |

Activity relative to SEQ ID NO: 1034 (Activity FIOP) was calculated as the product peak area of the variant compared with the product peak area observed by the reaction with SEQ ID NO: 1034 (where the peak area may be set as the average of replicates or else the highest single sample as appropriate). The results are shown in Table 21.2.

TABLE 21.2

| SEQ ID NO: (nt/aa) | Amino Acid Differences (Relative to SEQ ID NO: 1034) | FIOP Product Peak Area Relative to SEQ ID NO: 1034 |
|---|---|---|
| 1123/1124 | E65L | +++ |
| 1169/1170 | K353M | +++ |
| 1139/1140 | F71A | +++ |
| 1171/1172 | T133Y | +++ |
| 1135/1136 | L77I | +++ |
| 1129/1130 | L77V | +++ |
| 1173/1174 | E70A | +++ |
| 1131/1132 | I66S | +++ |
| 1175/1176 | M55R | +++ |
| 1127/1128 | K219L | +++ |
| 1177/1178 | N58M | +++ |
| 1179/1180 | S134V | +++ |
| 1181/1182 | E351Q | ++ |
| 1183/1184 | L69I | ++ |
| 1137/1138 | N58D | ++ |
| 1185/1186 | N64R | ++ |
| 1187/1188 | N58S | ++ |
| 1189/1190 | A328S | ++ |
| 1191/1192 | R352S | ++ |
| 1193/1194 | K353G | ++ |
| 1195/1196 | K62W | ++ |
| 1197/1198 | I355A | ++ |
| 1199/1200 | E350S | ++ |
| 1167/1168 | R345V | ++ |
| 1149/1150 | K219V | ++ |
| 1201/1202 | R73G | ++ |
| 1145/1146 | A328F | ++ |
| 1125/1126 | 1355V | ++ |
| 1203/1204 | K62R | ++ |
| 1205/1206 | N58C | ++ |
| 1207/1208 | E70H | ++ |
| 1209/1210 | Q131V | ++ |
| 1211/1212 | S134M | ++ |
| 1213/1214 | I54N | ++ |
| 1215/1216 | L319F | ++ |
| 1155/1156 | L52A | ++ |
| 1159/1160 | I66P | ++ |
| 1217/1218 | E57C | ++ |
| 1219/1220 | K353Q | ++ |
| 1221/1222 | A51L | ++ |
| 1223/1224 | F48Y | + |
| 1143/1144 | A74G | + |
| 1225/1226 | T322S | + |
| 1227/1228 | F71S | + |
| 1229/1230 | R352A | + |
| 1231/1232 | N64Q | + |
| 1233/1234 | K62G | + |
| 1235/1236 | Y59W | + |
| 1237/1238 | K47Q | + |
| 1239/1240 | I321V | + |
| 1241/1242 | F61T | + |
| 1147/1148 | K79R | + |
| 1243/1244 | R345Q | + |
| 1245/1246 | R345A | + |
| 1247/1248 | L332C | + |
| 1249/1250 | E70I | + |
| 1251/1252 | E325S | + |
| 1253/1254 | A51S | + |
| 1255/1256 | A328W | + |
| 1257/1258 | I355L | + |
| 1259/1260 | F48I | + |
| 1133/1134 | E70V | + |
| 1261/1262 | A328P | + |
| 1263/1264 | E63D | + |
| 1265/1266 | I66R | + |
| 1267/1268 | I54V | + |

Levels of increased activity were determined relative to the reference polypeptide of SEQ ID NO: 1034 and defined as follows: "+" 1.00 to 1.25, "++" >1.25, "+++" >1.75

Example 22

Improvements Over SEQ ID NO: 1270 in the Extension of Oligonucleotide Acceptor Molecules with Nucleotide Triphosphate Donors HTP Screening for Improved TdT Variants SEQ ID NO: 1270 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 22.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 22.1. The quenched reactions were centrifuged at 4,000 rpm for 10 min at 4° C. to pellet any precipitate. Supernatant was then transferred into new HTP plates for analytical analysis as described in Table 22.1.

TABLE 22.1

| All lysis, purification, reaction, quench, and analytical properties |
|---|
| Lysis and purification conditions; Lysis buffer-50 mM Tris buffer, pH 8.0, 75% (v/v) B-Per reagent (Thermo Fisher), 0.2 mg/ml lysozyme, 300 mM NaCl, 10 mM imidazole, and 0.2% (v/v) Triton X-100; Lysis buffer volume-350 μL; Lysate pre-treatment-Lysates were processed at 25° C., then centrifuged at 4,000 rpm for 10 min as described in Example 2 [Lysis of HTP Cell Pellets for HTP Purification of TdT from Crude Lysate]. The HTP purified enzymes were used in reactions. |
| Reaction conditions: Oligonucleotide-2 μM TTTTTTTATC; Nucleotide triphosphate-50 uM 3'PO4-dCTP; Reaction buffer-20 mM MOPS, pH 7.2, 0.002 Unit/μL yeast pyrophosphatase (Thermo Scientific), 50 mM potassium acetate, 250 μM cobalt (II) chloride; Reaction volume-20 μL; Lysate dilution-None; Reaction temperature-46° C.; Reaction time-60 minutes |
| Quench conditions: Quench solution and volume-Reactions were quenched by the addition of 24 μL acetonitrile. The solutions were mixed well and then further diluted by the addition of 16 μL of 20 mM aqueous EDTA.; Plate type and seal-96-well BioRad PCR plate with a plastic seal |
| Analytical conditions: Instrument-Agilent UHPLC 1260 prime series, Agilent Ultivo-see Example 4; Reaction product detected-TTTTTTTATCC-3'PO4 |

Activity relative to SEQ ID NO: 1270 (Activity FIOP) was calculated as the product peak area of the variant compared with the product peak area observed by the reaction with SEQ ID NO: 1270 (where the peak area may be set as the average of replicates or else the highest single sample as appropriate). The results are shown in Table 22.2.

TABLE 22.2

| SEQ ID NO: (nt/aa) | Amino Acid Differences (Relative to SEQ ID NO: 1270) | FIOP Product Peak Area Relative to SEQ ID NO: 1270 |
|---|---|---|
| 1271/1272 | S374E | +++ |
| 1273/1274 | T40S | +++ |
| 1275/1276 | A186D | +++ |
| 1277/1278 | P23L | +++ |
| 1279/1280 | L288H | ++ |
| 1281/1282 | Q32H | ++ |
| 1283/1284 | V309K | ++ |
| 1285/1286 | E107G | ++ |
| 1287/1288 | A186R | ++ |
| 1289/1290 | G93Q | + |
| 1291/1292 | T49S | + |
| 1293/1294 | E377N | + |
| 1295/1296 | P269R | + |
| 1297/1298 | G93W | + |
| 1299/1300 | S374G | + |
| 1301/1302 | Y386V | + |
| 1303/1304 | V117I | + |
| 1305/1306 | C182G | + |
| 1307/1308 | E107S | + |
| 1309/1310 | Q36H | + |
| 1311/1312 | E124P | + |
| 1313/1314 | G98P | + |
| 1315/1316 | L165M | + |

Levels of increased activity were determined relative to the reference polypeptide of SEQ ID NO: 1270 and defined as follows: "+" 1.04 to 1.20, "++" >1.20, "+++" >1.35

Example 23

Improvements Over SEQ ID NO: 1270 in the Extension of Oligonucleotide Acceptor Molecules with Nucleotide Triphosphate Donors HTP Screening for Improved TdT Variants SEQ ID NO: 1270 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 23.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 23.1. The quenched reactions were centrifuged at 4,000 rpm for 10 mi at 4° C. to pellet any precipitate. Supernatant was then transferred into new HTP plates for analytical analysis as described in Table 23.1.

TABLE 23.1

| All lysis, purification, reaction, quench, and analytical properties |
|---|
| Lysis and purification conditions: Lysis buffer-50 mM Tris buffer, pH 8.0, 75% (v/v) B-Per reagent (Thermo Fisher), 0.2 mg/ml lysozyme, 300 mM NaCl, 10 mM imidazole, and 0.2% (v/v) Triton X-100; Lysis buffer volume-350 μL; Lysate pre-treatment-Lysates were processed at 25° C., then centrifuged at 4,000 rpm for 10 min as described in Example 2 [Lysis of HTP Cell Pellets for HTP Purification of TdT from Crude Lysate]. The HTP purified enzymes were used in reactions. |
| Reaction conditions: Oligonucleotide-10 μM TTTTTTTATG; Nucleotide triphosphate-50 μM 3'PO4-dCTP; Reaction buffer-20 mM MOPS, pH 7.2, 0.002 Unit/μL yeast pyrophosphatase (Thermo Scientific), 50 mM potassium acetate, 250 μM cobalt (II) chloride; Reaction volume-20 μL; Lysate dilution-None; Reaction temperature-40° C.; Reaction time-60 minutes |
| Quench conditions: Quench solution and volume-Reactions were quenched by the addition of 24 μL acetonitrile. The solutions were mixed well and then further diluted by the addition of 16 μL of 20 mM aqueous EDTA.; Plate type and seal-96-well BioRad PCR plate with a plastic seal |
| Analytical conditions: Instrument-Agilent UHPLC 1260 prime series, Agilent Ultivo-see Example 4; Reaction product detected-TTTTTTTATGC-3'PO4 |

Activity relative to SEQ ID NO: 1270 (Activity FIOP) was calculated as the product peak area of the variant compared with the product peak area observed by the reaction with SEQ ID NO: 1270 (where the peak area may be set as the average of replicates or else the highest single sample as appropriate). The results are shown in Table 23.2.

TABLE 23.2

| SEQ ID NO: (nt/aa) | Amino Acid Differences (Relative to SEQ ID NO: 1270) | FIOP Product Peak Area Relative to SEQ ID NO: 1270 |
|---|---|---|
| 1273/1274 | T40S | +++ |
| 1275/1276 | A186D | +++ |
| 1283/1284 | V309K | +++ |
| 1285/1286 | E107G | ++ |
| 1291/1292 | T49S | ++ |
| 1271/1272 | S374E | ++ |
| 1317/1318 | G112T | + |
| 1319/1320 | R271Q | + |
| 1277/1278 | P23L | + |
| 1307/1308 | E107S | + |
| 1321/1322 | V120T | + |
| 1293/1294 | E377N | + |

Levels of increased activity were determined relative to the reference polypeptide of SEQ ID NO: 1270 and defined as follows: "+" 1.03 to 1.15, "++" >1.15, "+++" >1.20

Example 24

Improvements Over SEQ ID NO: 1270 in the Extension of Oligonucleotide Acceptor Molecules with Nucleotide Triphosphate Donors HTP Screening for Improved TdT Variants SEQ ID NO: 1270 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 24.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 24.1. The quenched reactions were centrifuged at 4,000 rpm for 10 min at 4° C. to pellet any precipitate. Supernatant was then transferred into new HTP plates for analytical analysis as described in Table 24.1.

TABLE 24.1

| All lysis, purification, reaction, quench, and analytical properties |
|---|
| Lysis and purification conditions: Lysis buffer-20 mM Tris-HCl, pH 8, 100 mM NaCl, 0.2 g/L lysozyme from chicken egg white; Lysis buffer volume-330 μL; Lysate pre-treatment-Lysates were processed at 25° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide-10 μM T7ATC; Nucleotide triphosphate-50 μM 3'PO4-dCTP; Reaction buffer-20 mM MOPS, pH 7.2, 0.002 Unit/μL yeast pyrophosphatase (Thermo Scientific), 50 mM potassium acetate, 250 μM cobalt (II) chloride; Reaction volume-20 μL; Lysate dilution-None; Reaction temperature-40° C.; Reaction time-60 minutes |
| Quench conditions: Quench solution and volume-Reactions were quenched by the addition of 24 μL acetonitrile. The solutions were mixed well and then further diluted by the addition of 16 μL of 20 mM aqueous EDTA.; Plate type and seal-96-well BioRad PCR plate with a plastic seal |
| Analytical conditions: Instrument-Agilent UHPLC 1260 prime series, Agilent Ultivo-see Example 4; Reaction product detected-TTTTTTTATCC-3'PO4 |

Activity relative to SEQ ID NO: 1270 (Activity FIOP) was calculated as the product peak area of the variant compared with the product peak area observed by the reaction with SEQ ID NO: 1270 (where the peak area may be set as the average of replicates or else the highest single sample as appropriate). The results are shown in Table 24.2.

TABLE 24.2

| SEQ ID NO: (nt/aa) | Amino Acid Differences (Relative to SEQ ID NO: 1270) | FIOP Product Peak Area Relative to SEQ ID NO: 1270 |
|---|---|---|
| 1323/1324 | G360A | +++ |
| 1325/1326 | S270T | +++ |
| 1327/1328 | I378C | ++ |
| 1329/1330 | C182R | ++ |
| 1331/1332 | P23V | ++ |
| 1333/1334 | A372G | + |
| 1335/1336 | P269A | + |
| 1337/1338 | A186E | + |
| 1339/1340 | V293G | + |
| 1341/1342 | C182A | + |

Levels of increased activity were determined relative to the reference polypeptide of SEQ ID NO: 1270 and defined as follows: "+" 1.05 to 1.20, "++" >1.20, "+++" >1.30

Example 25

Improvements Over SEQ ID NO: 1344 in the Extension of Oligonucleotide Acceptor Molecules with Nucleotide Triphosphate Donors HTP Screening for Improved TdT Variants SEQ ID NO: 1344 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 25.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 25.1. The quenched reactions were centrifuged at 4,000 rpm for 10 min at 4° C. to pellet any precipitate. Supernatant was then transferred into new HTP plates for analytical analysis as described in Table 25.1.

TABLE 25.1

| All lysis, purification, reaction, quench, and analytical properties |
|---|
| Lysis and purification conditions: Lysis buffer-20 mM Tris-HCl, pH 8, 0.2 g/L lysozyme from chicken egg white; Lysis buffer volume-300 μL; Lysate pre-treatment-Lysates were processed at 25° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide-4 μM TTTTTTTATC; Nucleotide triphosphate-50 μM 3'PO4-dCTP; Reaction buffer-20 mM MOPS, pH 7.2, 0.002 Unit/μL yeast pyrophosphatase (Thermo Scientific), 50 mM potassium acetate, 250 μM cobalt (II) chloride; Reaction volume-20 μL; Lysate dilution-None; Reaction temperature-46° C.; Reaction time-60 minutes |
| Quench conditions: Quench solution and volume-Reactions were quenched by the addition of 24 μL acetonitrile. The solutions were mixed well and then further diluted by the addition of 16 μL of 20 mM aqueous EDTA.; Plate type and seal-96-well BioRad PCR plate with a plastic seal |
| Analytical conditions: Instrument-Agilent UHPLC 1260 prime series, Agilent Ultivo-see Example 4; Reaction product detected-TTTTTTTATCC-3'PO4 |

Activity relative to SEQ ID NO: 1344 (Activity FIOP) was calculated as the product peak area of the variant compared with the product peak area observed by the reaction with SEQ ID NO: 1344 (where the peak area may be set as the average of replicates or else the highest single sample as appropriate). The results are shown in Table 25.2.

TABLE 25.2

| SEQ ID NO: (nt/aa) | Amino Acid Differences (Relative to SEQ ID NO: 1344) | FIOP Product Peak Area Relative to SEQ ID NO: 1344 |
|---|---|---|
| 1345/1346 | F71A/L77I/K353G | +++ |
| 1347/1348 | L77I/K353M | +++ |
| 1349/1350 | K353G | +++ |
| 1351/1352 | F71A/K353G | +++ |
| 1353/1354 | L77I | ++ |

TABLE 25.2-continued

| SEQ ID NO: (nt/aa) | Amino Acid Differences (Relative to SEQ ID NO: 1344) | FIOP Product Peak Area Relative to SEQ ID NO: 1344 |
|---|---|---|
| 1355/1356 | N58S/C256E | ++ |
| 1357/1358 | L77I/S134V/K353G | ++ |
| 1359/1360 | K353M | ++ |
| 1361/1362 | E70V/K353M | ++ |
| 1363/1364 | S134V/K353G | ++ |
| 1365/1366 | N58S/L69I/C256E/G373D | + |
| 1367/1368 | E70V/S134M/K353G | + |
| 1369/1370 | E70V/F71A | + |
| 1371/1372 | N58D | + |
| 1373/1374 | E70V/F71A/K353G | + |
| 1375/1376 | N58S/D99V/E351Q/I355A | + |
| 1377/1378 | E350S | + |
| 1379/1380 | M55R/N58D/C256E/E350S/G373D | + |
| 1381/1382 | D99V/C256E/E351Q/I355A | + |
| 1383/1384 | C256E | + |

Levels of increased activity were determined relative to the reference polypeptide of SEQ ID NO: 1344 and defined as follows: "+" 1.20 to 1.75, "++" >1.75, "+++" >3.00

Example 26

Improvements Over SEQ ID NO: 1344 in the Extension of Oligonucleotide Acceptor Molecules with Nucleotide Triphosphate Donors HTP Screening for Improved TdT Variants SEQ ID NO: 1344 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 26.1.

Reactions were performed in 96-well format 200 L Bio-Rad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 26.1. The quenched reactions were centrifuged at 4,000 rpm for 10 min at 4° C. to pellet any precipitate. Supernatant was then transferred into new HTP plates for analytical analysis as described in Table 26.1.

TABLE 26.1

| All lysis, purification, reaction, quench, and analytical properties |
|---|
| Lysis and purification conditions: Lysis buffer-50 mM Tris buffer, pH 8.0, 75% (v/v) B-Per reagent (Thermo Fisher), 0.2 mg/ml lysozyme, 300 mM NaCl, 10 mM imidazole, and 0.2% (v/v) Triton X-100; Lysis buffer volume-400 μL; Lysate pre-treatment-Lysates were processed at 25° C., then centrifuged at 4,000 rpm for 10 min as described in Example 2 [Lysis of HTP Cell Pellets for HTP Purification of TdT from Crude Lysate]. The HTP purified enzymes were used in reactions. |
| Reaction conditions: Oligonucleotide-4 μM TTTTTTTATC; Nucleotide triphosphate-50 uM 3'PO4-dCTP; Reaction buffer-20 mM MOPS, pH 7.2, 0.002 Unit/μL yeast pyrophosphatase (Thermo Scientific), 50 mM potassium acetate, 250 μM cobalt (II) chloride; Reaction volume-20 μL; Lysate dilution-None; Reaction temperature-46° C.; Reaction time-60 minutes |
| Quench conditions: Quench solution and volume-Reactions were quenched by the addition of 24 μL acetonitrile. The solutions were mixed well and then further diluted by the addition of 16 μL of 20 mM aqueous EDTA.; Plate type and seal-96-well BioRad PCR plate with a plastic seal |
| Analytical conditions: Instrument-Agilent UHPLC 1260 prime series, Agilent Ultivo-see Example 4; Reaction product detected-TTTTTTTATCC-3'PO4 |

Activity relative to SEQ ID NO: 1344 (Activity FIOP) was calculated as the product peak area of the variant compared with the product peak area observed by the reaction with SEQ ID NO: 1344 (where the peak area may be set as the average of replicates or else the highest single sample as appropriate). The results are shown in Table 26.2.

TABLE 26.2

| SEQ ID NO: (nt/aa) | Amino Acid Differences (Relative to SEQ ID NO: 1344) | FIOP Product Peak Area Relative to SEQ ID NO: 1344 |
|---|---|---|
| 1385/1386 | M55R/N58S/E350S/E351Q | +++ |
| 1387/1388 | K353G | +++ |
| 1389/1390 | M55R/N58M | +++ |
| 1391/1392 | E70V/K353G | +++ |
| 1393/1394 | M55R/N58S/D99V/E351Q | +++ |
| 1395/1396 | N58S/E350S/I355V | +++ |
| 1397/1398 | M55R/N58S/C256E/I355A | ++ |
| 1399/1400 | F71A/K353G | ++ |
| 1401/1402 | M55R/N58M/C256E | ++ |
| 1403/1404 | N58M/C256E/E350S/I355V | ++ |
| 1405/1406 | L77I/T133Y/K353G | ++ |
| 1407/1408 | F71A/L77I/T133Y/K353M | ++ |
| 1409/1410 | L77I/K353G | ++ |
| 1411/1412 | M55R/N58S/D99V/C256E/E351Q/G373D | ++ |
| 1413/1414 | E70L | + |
| 1415/1416 | N58D/D99V/I355V | + |
| 1417/1418 | M55R/N58M/L69I/E350S/E351Q | + |
| 1419/1420 | K353M | + |
| 1421/1422 | N58S/D99V | + |
| 1423/1424 | L77I/T133Y/K353M | + |
| 1425/1426 | I355V/G373D | + |
| 1427/1428 | M55R/N58S/D99V/C256E/I355A | + |
| 1429/1430 | T133Y | + |

Levels of increased activity were determined relative to the reference polypeptide of SEQ ID NO: 1344 and defined as follows: "+" 1.16 to 1.50, "++" >1.50, "+++" >1.75

Example 27

Improvements Over SEQ ID NO: 1344 in the Extension of Oligonucleotide Acceptor Molecules with Nucleotide Triphosphate Donors HTP Screening for Improved TdT Variants SEQ ID NO: 1344 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 27.1.

Reactions were performed in 96-well format 200 L Bio-Rad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 27.1. The quenched reactions were centrifuged at 4,000 rpm for 10 min at 4° C. to pellet any precipitate. Supernatant was then transferred into new HTP plates for analytical analysis as described in Table 27.1.

TABLE 27.1

| All lysis, purification, reaction, quench, and analytical properties |
|---|
| Lysis and purification conditions: Lysis buffer-20 mM Tris-HCl, pH 8, 0.2 g/L lysozyme from chicken egg white; Lysis buffer volume-300 μL; Lysate pre-treatment-Lysates were preincubated at 42° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide-4 μM TTTTTTTATC; Nucleotide triphosphate-50 μM 3'PO4-dCTP; Reaction buffer-20 mM MOPS, pH 7.2, 0.002 Unit/μL yeast pyrophosphatase (Thermo Scientific), 50 mM potassium acetate, 250 μM cobalt (II) chloride; Reaction volume-20 μL; Lysate dilution-None; Reaction temperature-46° C.; Reaction time-30 minutes |
| Quench conditions: Quench solution and volume-Reactions were quenched by the addition of 24 μL acetonitrile. The solutions were mixed well and then further diluted by the addition of 16 μL of 20 mM aqueous EDTA.; Plate type and seal-96-well BioRad PCR plate with a plastic seal |
| Analytical conditions: Instrument-Agilent UHPLC 1260 prime series, Agilent Ultivo-see Example 4; Reaction product detected-TTTTTTTATCC-3'PO4 |

Activity relative to SEQ ID NO: 1344 (Activity FIOP) was calculated as the product peak area of the variant compared with the product peak area observed by the reaction with SEQ ID NO: 1344 (where the peak area may be set as the average of replicates or else the highest single sample as appropriate). The results are shown in Table 27.2.

TABLE 27.2

| SEQ ID NO: (nt/aa) | Amino Acid Differences (Relative to SEQ ID NO: 1344) | FIOP Product Peak Area Relative to SEQ ID NO: 1344 |
|---|---|---|
| 1431/1432 | G9D | +++ |
| 1433/1434 | I368S | +++ |
| 1435/1436 | A380G | +++ |
| 1437/1438 | P233R | +++ |
| 1439/1440 | K302A | +++ |
| 1441/1442 | N16G | +++ |
| 1443/1444 | Q100E | ++ |
| 1445/1446 | K89G | ++ |
| 1447/1448 | T201G | ++ |
| 1449/1450 | N197G | ++ |
| 1451/1452 | R364W | ++ |
| 1453/1454 | K302G | ++ |
| 1455/1456 | G8S | ++ |
| 1457/1458 | Y298D | ++ |
| 1459/1460 | D237A | ++ |
| 1461/1462 | K29R | ++ |
| 1463/1464 | D237G | ++ |

TABLE 27.2-continued

| SEQ ID NO: (nt/aa) | Amino Acid Differences (Relative to SEQ ID NO: 1344) | FIOP Product Peak Area Relative to SEQ ID NO: 1344 |
|---|---|---|
| 1465/1466 | K89Y | ++ |
| 1467/1468 | P14G | + |
| 1469/1470 | R364F | + |
| 1471/1472 | P14E | + |
| 1473/1474 | N42V | + |
| 1475/1476 | Y289G | + |
| 1477/1478 | R28G | + |
| 1479/1480 | A190V | + |
| 1481/1482 | S15E | + |
| 1483/1484 | R116L | + |
| 1485/1486 | R125K | + |

Levels of increased activity were determined relative to the reference polypeptide of SEQ ID NO: 1344 and defined as follows: "+" 1.04 to 1.25, "++" >1.25, "+++" >1.50

Example 28

Improvements Over SEQ ID NO: 1344 in the Extension of Oligonucleotide Acceptor Molecules with Nucleotide Triphosphate Donors HTP Screening for Improved TdT Variants SEQ ID NO: 1344 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 28.1.

Reactions were performed in 96-well format 200 L Bio-Rad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 28.1. The quenched reactions were centrifuged at 4,000 rpm for 10 min at 4° C. to pellet any precipitate. Supernatant was then transferred into new HTP plates for analytical analysis as described in Table 28.1.

TABLE 28.1

| All lysis, purification, reaction, quench, and analytical properties |
|---|
| Lysis and purification conditions: Lysis buffer-20 mM Tris-HCl, pH 8, 0.2 g/L lysozyme from chicken egg white; Lysis buffer volume-300 μL; Lysate pre-treatment-Lysates were preincubated at 42° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide-4 μM TTTTTTTATC; Nucleotide triphosphate-50 μM 3'PO4-dCTP; Reaction buffer-20 mM MOPS, pH 7.2, 0.002 Unit/μL yeast pyrophosphatase (Thermo Scientific), 50 mM potassium acetate, 250 μM cobalt (II) chloride; Reaction volume-20 μL; Lysate dilution-None; Reaction temperature-46° C.; Reaction time-30 minutes |

TABLE 28.1-continued

| All lysis, purification, reaction, quench, and analytical properties |
|---|
| Quench conditions: Quench solution and volume-Reactions were quenched by the addition of 24 μL acetonitrile. The solutions were mixed well and then further diluted by the addition of 16 μL of 20 mM aqueous EDTA.; Plate type and seal-96-well BioRad PCR plate with a plastic seal |
| Analytical conditions: Instrument-Agilent UHPLC 1260 prime series, Agilent Ultivo-see Example 4; Reaction product detected-TTTTTTTATCC-3'PO4 |

Activity relative to SEQ ID NO: 1344 (Activity FIOP) was calculated as the product peak area of the variant compared with the product peak area observed by the reaction with SEQ ID NO: 1344 (where the peak area may be set as the average of replicates or else the highest single sample as appropriate). The results are shown in Table 28.2.

TABLE 28.2

| SEQ ID NO: (nt/aa) | Amino Acid Differences (Relative to SEQ ID NO: 1344) | FIOP Product Peak Area Relative to SEQ ID NO: 1344 |
|---|---|---|
| 1487/1488 | R364L | +++ |
| 1489/1490 | G9E | +++ |
| 1491/1492 | P14I | +++ |
| 1493/1494 | Y298V | +++ |
| 1495/1496 | R28S | +++ |
| 1497/1498 | T86Q | +++ |
| 1499/1500 | G341T | +++ |
| 1501/1502 | I91C | +++ |
| 1503/1504 | Q92V | +++ |
| 1505/1506 | 191V | +++ |
| 1507/1508 | G341E | +++ |
| 1509/1510 | K89D | ++ |
| 1511/1512 | S304V | ++ |
| 1513/1514 | K196C | ++ |
| 1515/1516 | K365G | ++ |
| 1517/1518 | E308D | ++ |
| 1519/1520 | K248W | ++ |
| 1521/1522 | K248L | ++ |
| 1523/1524 | E266Q | ++ |
| 1525/1526 | N278S | ++ |
| 1527/1528 | R28I | ++ |
| 1529/1530 | K196F | ++ |
| 1531/1532 | K196R | ++ |
| 1533/1534 | N197R | + |
| 1535/1536 | R125F | + |
| 1537/1538 | A380G | + |
| 1539/1540 | R125A | + |
| 1541/1542 | Q92F | + |
| 1543/1544 | V104I | + |
| 1545/1546 | N230D | + |
| 1547/1548 | K272G | + |
| 1549/1550 | K234Q | + |
| 1551/1552 | N230I | + |
| 1553/1554 | A307L | + |
| 1555/1556 | R364N | + |
| 1557/1558 | T198C | + |
| 1559/1560 | R116T | + |
| 1561/1562 | A380M | + |
| 1563/1564 | Q92A | + |
| 1565/1566 | T201L | + |

Levels of increased activity were determined relative to the reference polypeptide of SEQ ID NO: 1344 and defined as follows: "+" 1.10 to 1.20, "++" >1.20, "+++" >1.30

Example 29

Improvements Over SEQ ID NO: 1346 in the Extension of Oligonucleotide Acceptor Molecules with Nucleotide Triphosphate Donors HTP Screening for Improved TdT Variants SEQ ID NO: 1346 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 29.1.

Reactions were performed in 96-well format 200 μL BioRad PCR plates. Reactions included 1-4 μM oligonucleotide, 25-200 mM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 29.1. The quenched reactions were centrifuged at 4,000 rpm for 10 min at 4° C. to pellet any precipitate. Supernatant was then transferred into new HTP plates for analytical analysis as described in Table 29.1.

TABLE 29.1

| All lysis, purification, reaction, quench, and analytical properties |
|---|
| Lysis and purification conditions: Lysis buffer-20 mM Tris-acetate, pH 8, 0.2 g/L lysozyme from chicken egg white; Lysis buffer volume-300 μL; Lysate pre-treatment-Lysates were preincubated at 46° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide-4 μM TTTTTTTATG; Nucleotide triphosphate-50 μM 3'PO4-dCTP; Reaction buffer-20 mM MOPS, pH 7.2, 0.002 Unit/μL yeast pyrophosphatase (Thermo Scientific), 50 mM potassium acetate, 250 μM cobalt (II) chloride; Reaction volume-20 μL; Lysate dilution-None; Reaction temperature-46° C.; Reaction time-15 minutes |
| Quench conditions: Quench solution and volume-Reactions were quenched by the addition of 24 μL acetonitrile. The solutions were mixed well and then further diluted by the addition of 16 μL of 20 mM aqueous EDTA.; Plate type and seal-96-well BioRad PCR plate with a plastic seal |
| Analytical conditions: Instrument-Agilent UHPLC 1260 prime series, Agilent Ultivo-see Example 4; Reaction product detected-TTTTTTTATGC-3'PO4 |

Activity relative to SEQ ID NO: 1346 (Activity FIOP) was calculated as the product peak area of the variant compared with the product peak area observed by the reaction with SEQ ID NO: 1346 (where the peak area may be set as the average of replicates or else the highest single sample as appropriate). The results are shown in Table 29.2.

TABLE 29.2

| SEQ ID NO: (nt/aa) | Amino Acid Differences (Relative to SEQ ID NO: 1346) | FIOP Product Peak Area Relative to SEQ ID NO: 1346 |
|---|---|---|
| 1567/1568 | P204L | +++ |
| 1569/1570 | P204R | +++ |
| 1571/1572 | P204M | +++ |
| 1573/1574 | R28G | +++ |
| 1575/1576 | Q290V | +++ |

TABLE 29.2-continued

| SEQ ID NO: (nt/aa) | Amino Acid Differences (Relative to SEQ ID NO: 1346) | FIOP Product Peak Area Relative to SEQ ID NO: 1346 |
| --- | --- | --- |
| 1577/1578 | F173L | +++ |
| 1579/1580 | K303T | ++ |
| 1581/1582 | F147Y | ++ |
| 1583/1584 | Q290R | ++ |
| 1585/1586 | R28E | ++ |
| 1587/1588 | K303G | ++ |
| 1589/1590 | K170R | ++ |
| 1591/1592 | Q92E | ++ |
| 1593/1594 | G98A | ++ |
| 1595/1596 | P84E | ++ |
| 1597/1598 | P204I | ++ |
| 1599/1600 | S297A | ++ |
| 1603/1604 | N197E | + |
| 1605/1606 | G98T | + |
| 1607/1608 | L193V | + |
| 1609/1610 | P204F | + |
| 1611/1612 | L193S | + |
| 1613/1614 | SI 62 A | + |
| 1615/1616 | K185R | + |
| 1617/1618 | E110L | + |
| 1619/1620 | S143A | + |
| 1621/1622 | K29C | + |
| 1623/1624 | A27L | + |
| 1625/1626 | K158R | + |
| 1627/1628 | L193R | + |

TABLE 29.2-continued

| SEQ ID NO: (nt/aa) | Amino Acid Differences (Relative to SEQ ID NO: 1346) | FIOP Product Peak Area Relative to SEQ ID NO: 1346 |
| --- | --- | --- |
| 1629/1630 | P204E/V264L/F340L | + |
| 1631/1632 | L174M | + |
| 1633/1634 | K29P | + |
| 1635/1636 | S181R | + |

Levels of increased activity were determined relative to the reference polypeptide of SEQ ID NO: 1346 and defined as follows: "+" 1.02 to 1.40, "++" >1.40, "+++" >1.60

Example 30

Improvements Over SEQ ID NO: 1346 in the Extension of Oligonucleotide Acceptor Molecules with Nucleotide Triphosphate Donors

HTP Screening for Improved TdT Variants

SEQ ID NO: 1346 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 30.1.

Reactions were performed in 96-well format 200 L Bio-Rad PCR plates. Reactions included 1-4 µM oligonucle-otide, 25-200 µM nucleotide triphosphate, 0.002 Unit/µL yeast pyrophosphatase (Thermo Scientific), 20 mM buffer, 50 mM potassium acetate, and 250 µM cobalt (II) chloride. The reactions were set up as follows: (i) all reaction components, except for TdT, were pre-mixed in a single solution, and 15 µL of this solution was aliquoted into each well of the 96-well plates (ii) 5 µL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 30.1. The quenched reactions were centrifuged at 4,000 rpm for 10 min at 4° C. to pellet any precipitate. Supernatant was then transferred into new HTP plates for analytical analysis as described in Table 30.1.

TABLE 30.1

All lysis, purification, reaction, quench, and analytical properties

Lysis and purification conditions: Lysis buffer-20 mM Tris-HCl, pH 8, 0.2 g/L lysozyme from chicken egg white; Lysis buffer volume-300 µL; Lysate pre-treatment-Lysates were preincubated at 47° C. for one hour, then centrifuged at 4,000 rpm for 10 min as described in Example 2 [Lysis of HTP Cell Pellets with Lysozyme]. The clarified supernatants were used in reactions.
Reaction conditions: Oligonucleotide-4 µM TTTTTTTATC; Nucleotide triphosphate-50 µM 3'PO4-dGTP; Reaction buffer-20 mM MOPS, pH 7.2, 0.002 Unit/µL yeast pyrophosphatase (Thermo Scientific), 50 mM potassium acetate, 250 µM cobalt (II) chloride; Reaction volume-20 µL; Lysate dilution-None; Reaction temperature-50° C.; Reaction time-30 minutes
Quench conditions: Quench solution and volume-Reactions were quenched by the addition of 24 µL acetonitrile. The solutions were mixed well and then further diluted by the addition of 16 µL of 20 mM aqueous EDTA.; Plate type and seal-96-well BioRad PCR plate with a plastic seal
Analytical conditions: Instrument-Agilent UHPLC 1260 prime series, Agilent Ultivo-see Example 4; Reaction product detected-TTTTTTTATCG-3'PO4

Activity relative to SEQ ID NO: 1346 (Activity FIOP) was calculated as the product peak area of the variant compared with the product peak area observed by the reaction with SEQ ID NO: 1346 (where the peak area may be set as the average of replicates or else the highest single sample as appropriate). The results are shown in Table 30.2.

TABLE 30.2

| SEQ ID NO: (nt/aa) | Amino Acid Differences (Relative to SEQ ID NO: 1346) | FIOP Product Peak Area Relative to SEQ ID NO: 1346 |
| --- | --- | --- |
| 1619/1620 | S143A | +++ |
| 1591/1592 | Q92E | +++ |
| 1637/1638 | F147Y | +++ |
| 1639/1640 | K185R | +++ |
| 1577/1578 | F173L | +++ |
| 1641/1642 | K196E | ++ |
| 1643/1644 | P233E | ++ |
| 1645/1646 | I66G | ++ |
| 1647/1648 | F324I | ++ |
| 1649/1650 | Y44H | ++ |
| 1651/1652 | E57D/R367K | ++ |
| 1625/1626 | K158R | ++ |
| 1653/1654 | R352K | + |
| 1655/1656 | I224V | + |

TABLE 30.2-continued

| SEQ ID NO: (nt/aa) | Amino Acid Differences (Relative to SEQ ID NO: 1346) | FIOP Product Peak Area Relative to SEQ ID NO: 1346 |
|---|---|---|
| 1657/1658 | K248E | + |
| 1603/1604 | N197E | + |
| 1659/1660 | S160E | + |
| 1661/1662 | E111D | + |
| 1663/1664 | V101S | + |
| 1665/1666 | V154L | + |
| 1667/1668 | S184T | + |
| 1669/1670 | R102K | + |
| 1671/1672 | E156D | + |
| 1673/1674 | K167R | + |
| 1675/1676 | K38R | + |

Levels of increased activity were determined relative to the reference polypeptide of SEQ ID NO: 1346 and defined as follows: "+" 1.33 to 1.75, "++" >1.75, "+++" >2.00

Example 31

Improvements Over SEQ ID NO: 1346 in the Extension of Oligonucleotide Acceptor Molecules with Nucleotide Triphosphate Donors HTP Screening for Improved TdT Variants SEQ ID NO: 1346 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 31.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 31.1. The quenched reactions were centrifuged at 4,000 rpm for 10 min at 4° C. to pellet any precipitate. Supernatant was then transferred into new HTP plates for analytical analysis as described in Table 31.1.

TABLE 31.1

| All lysis, purification, reaction, quench, and analytical properties |
|---|
| Lysis and purification conditions: Lysis buffer-20 mM Tris-HCl, pH 8, 0.2 g/L lysozyme from chicken egg white; Lysis buffer volume-300 μL; Lysate pre-treatment-Lysates were preincubated at 46° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide-4 μM TTTTTTTATC; Nucleotide triphosphate-50 μM 3'PO4-dGTP; Reaction buffer-20 mM MOPS, pH 7.2, 0.002 Unit/μL yeast pyrophosphatase (Thermo Scientific), 50 mM potassium acetate, 250 μM cobalt (II) chloride; Reaction volume-20 μL; Lysate dilution-None; Reaction temperature-50° C.; Reaction time-30 minutes |
| Quench conditions: Quench solution and volume-Reactions were quenched by the addition of 24 μL acetonitrile. The solutions were mixed well and then further diluted by the addition of 16 μL of 20 mM aqueous EDTA.; Plate type and seal-96-well BioRad PCR plate with a plastic seal |
| Analytical conditions: Instrument-Agilent UHPLC 1260 prime series, Agilent Ultivo-see Example 4; Reaction product detected-TTTTTTTATCG-3'PO4 |

Activity relative to SEQ ID NO: 1346 (Activity FIOP) was calculated as the product peak area of the variant compared with the product peak area observed by the reaction with SEQ ID NO: 1346 (where the peak area may be set as the average of replicates or else the highest single sample as appropriate). The results are shown in Table 31.2.

TABLE 31.2

| SEQ ID NO: (nt/aa) | Amino Acid Differences (Relative to SEQ ID NO: 1346) | FIOP Product Peak Area Relative to SEQ ID NO: 1346 |
|---|---|---|
| 1677/1678 | C182R/A186E/C256E/G360A | +++ |
| 1679/1680 | C182R/C256E | +++ |
| 1681/1682 | A186E/C256E/S270T | ++ |
| 1683/1684 | S270T/V309K | ++ |
| 1685/1686 | A186E/C256E | + |
| 1687/1688 | N58S/A186E/S270T | + |
| 1689/1690 | P23V/A186E/C256E/V309K | + |
| 1691/1692 | C256E | + |

Levels of increased activity were determined relative to the reference polypeptide of SEQ ID NO: 1346 and defined as follows: "+" 1.14 to 2.00, "++" >2.00, "+++" >3.00

Example 32

Improvements Over SEQ ID NO: 1678 in the Extension of Oligonucleotide Acceptor Molecules with Nucleotide Triphosphate Donors HTP Screening for Improved TdT Variants SEQ ID NO: 1678 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 32.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 32.1. The quenched reactions were centrifuged at 4,000 rpm for 10 min at 4° C. to pellet any precipitate. Supernatant was then transferred into new HTP plates for analytical analysis as described in Table 32.1.

TABLE 32.1

| All lysis, purification, reaction, quench, and analytical properties |
|---|
| Lysis and purification conditions: Lysis buffer-20 mM Tris-acetate, pH 8, 0.2 g/L lysozyme from chicken egg white; Lysis buffer volume-300 μL; Lysate pre-treatment-Lysates were preincubated at 44° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide-4 μM TTTTTTTATC; Nucleotide triphosphate-50 μM 3'PO4-dCTP; Reaction buffer-20 mM MOPS, pH 7.2, 0.002 Unit/μL yeast pyrophosphatase (Thermo Scientific), 50 mM potassium acetate, 250 μM cobalt (II) chloride; Reaction volume-20 μL; Lysate dilution-None; Reaction temperature-46° C.; Reaction time-15 minutes |
| Quench conditions: Quench solution and volume-Reactions were quenched by the addition of 24 μL acetonitrile. The solutions were mixed well and then further diluted by the addition of 16 μL of 20 mM aqueous EDTA.; Plate type and seal-96-well BioRad PCR plate with a plastic seal |
| Analytical conditions: Instrument-Agilent UHPLC 1260 prime series, Agilent Ultivo-see Example 4; Reaction product detected-TTTTTTTATCC-3'PO4 |

Activity relative to SEQ ID NO: 1678 (Activity FIOP) was calculated as the product peak area of the variant compared with the product peak area observed by the reaction with SEQ ID NO: 1678 (where the peak area may be set as the average of replicates or else the highest single sample as appropriate). The results are shown in Table 32.2.

TABLE 32.2

| SEQ ID NO: (nt/aa) | Amino Acid Differences (Relative to SEQ ID NO: 1678) | FIOP Product Peak Area Relative to SEQ ID NO: 1678 |
|---|---|---|
| 1693/1694 | G341K | +++ |
| 1695/1696 | G341V | +++ |
| 1697/1698 | G341I | ++ |
| 1699/1700 | G341R | ++ |
| 1701/1702 | G341L | + |
| 1703/1704 | G341M | + |
| 1705/1706 | G341C | + |
| 1707/1708 | G341T | + |
| 1709/1710 | G341H | + |

Levels of increased activity were determined relative to the reference polypeptide of SEQ ID NO: 1678 and defined as follows: "+" 1.04 to 1.25, "++" >1.25, "+++" >1.40

Example 33

Improvements Over SEQ ID NO: 1678 in the Extension of Oligonucleotide Acceptor Molecules with Nucleotide Triphosphate Donors HTP Screening for Improved TdT Variants SEQ ID NO: 1678 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 33.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 33.1. The quenched reactions were centrifuged at 4,000 rpm for 10 min at 4° C. to pellet any precipitate. Supernatant was then transferred into new HTP plates for analytical analysis as described in Table 33.1.

TABLE 33.1

| All lysis, purification, reaction, quench, and analytical properties |
|---|
| Lysis and purification conditions: Lysis buffer-20 mM Tris-acetate, pH 8, 0.2 g/L lysozyme from chicken egg white; Lysis buffer volume-300 μL; Lysate pre-treatment-Lysates were preincubated at 44° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide-4 μM TTTTTTTATG; Nucleotide triphosphate-50 μM 3'PO4-dTTP; Reaction buffer-20 mM MOPS, pH 7.2, 0.002 Unit/μL yeast pyrophosphatase (Thermo Scientific), 50 mM potassium acetate, 250 μM cobalt (II) chloride; Reaction volume-20 μL; Lysate dilution-None; Reaction temperature-44° C.; Reaction time-15 minutes |
| Quench conditions: Quench solution and volume-Reactions were quenched by the addition of 24 μL acetonitrile. The solutions were mixed well and then further diluted by the addition of 16 μL of 20 mM aqueous EDTA.; Plate type and seal-96-well BioRad PCR plate with a plastic seal |
| Analytical conditions: Instrument-Agilent UHPLC 1260 prime series, Agilent Ultivo-see Example 4; Reaction product detected-TTTTTTTATGT-3'PO4 |

Activity relative to SEQ ID NO: 1678 (Activity FIOP) was calculated as the product peak area of the variant compared with the product peak area observed by the reaction with SEQ ID NO: 1678 (where the peak area may be set as the average of replicates or else the highest single sample as appropriate). The results are shown in Table 33.2.

TABLE 33.2

| SEQ ID NO: (nt/aa) | Amino Acid Differences (Relative to SEQ ID NO: 1678) | FIOP Product Peak Area Relative to SEQ ID NO: 1678 |
|---|---|---|
| 1711/1712 | G9E/P14I/N58S/R182C/A190V/ N197G/Y298V | +++ |
| 1713/1714 | N58S/N197G/R364L | +++ |
| 1715/1716 | G9E/P14I/A190V/N197G/R364L | +++ |
| 1717/1718 | N197G/Y298V | +++ |
| 1719/1720 | R182C/N197G | ++ |
| 1721/1722 | P14I/A190V/N197G/Y298V | ++ |
| 1723/1724 | N58S/R364L | ++ |
| 1725/1726 | P14I/N197G/Y298V/R364L | ++ |
| 1727/1728 | N58S/N197G | ++ |
| 1729/1730 | G9D/P14I/N58S | + |
| 1731/1732 | R182C | + |
| 1733/1734 | P14I/Y298V/R364F | + |
| 1735/1736 | P14I/N58S/R182C/N197G/ | + |

TABLE 33.2-continued

| SEQ ID NO: (nt/aa) | Amino Acid Differences (Relative to SEQ ID NO: 1678) | FIOP Product Peak Area Relative to SEQ ID NO: 1678 |
|---|---|---|
|  | Y298V/R364L |  |
| 1737/1738 | G9D/Y298V | + |
| 1739/1740 | R182C/Y298V/R364L | + |
| 1741/1742 | G9E/N58S/N197G | + |
| 1743/1744 | S10I/P14I/N197G/R364L | + |
| 1745/1746 | Y298V | + |

Levels of increased activity were determined relative to the reference polypeptide of SEQ ID NO: 1678 and defined as follows: "+" 1.20 to 1.50, "++" >1.50, "+++" >1.60

Example 34

Improvements Over SEQ ID NO: 1700 in the Extension of Oligonucleotide Acceptor Molecules with Nucleotide Triphosphate Donors HTP Screening for Improved TdT Variants SEQ ID NO: 1700 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 34.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 34.1. The quenched reactions were centrifuged at 4,000 rpm for 10 min at 4° C. to pellet any precipitate. Supernatant was then transferred into new HTP plates for analytical analysis as described in Table 34.1.

TABLE 34.1

All lysis, purification, reaction, quench, and analytical properties

Lysis and purification conditions: Lysis buffer-20 mM Tris-acetate, pH 8, 0.2 g/L lysozyme from chicken egg white; Lysis buffer volume-300 μL; Lysate pre-treatment-Lysates were preincubated at 50° C. for one hour, then centrifuged at 4,000 rpm for 10 min as described in Example 2 [Lysis of HTP Cell Pellets with Lysozyme]. The clarified supernatants were used in reactions.
Reaction conditions: Oligonucleotide-4 μM TTTTTTTATC; Nucleotide triphosphate-50 μM 3'PO4-dGTP; Reaction buffer-20 mM MOPS, pH 7.2, 0.002 Unit/μL yeast pyrophosphatase (Thermo Scientific), 50 mM potassium acetate, 250 μM cobalt (II) chloride; Reaction volume-20 μL; Lysate dilution-None; Reaction temperature-50° C.; Reaction time-15 minutes
Quench conditions: Quench solution and volume-Reactions were quenched by the addition of 24 μL acetonitrile. The solutions were mixed well and then further diluted by the addition of 16 μL of 20 mM aqueous EDTA.; Plate type and seal-96-well BioRad PCR plate with a plastic seal
Analytical conditions: Instrument-Thermo Accela, Thermo LTQ XL-see Example 5; Reaction product detected-TTTTTTTATCG-3'PO4

Activity relative to SEQ ID NO: 1700 (Activity FIOP) was calculated as the product peak area of the variant compared with the product peak area observed by the reaction with SEQ ID NO: 1700 (where the peak area may be set as the average of replicates or else the highest single sample as appropriate). The results are shown in Table 34.2.

TABLE 34.2

| SEQ ID NO: (nt/aa) | Amino Acid Differences (Relative to SEQ ID NO: 1700) | FIOP Product Peak Area Relative to SEQ ID NO: 1700 |
|---|---|---|
| 1747/1748 | K29P/S143A/K185R/L193S/E266G | +++ |
| 1749/1750 | K29P/G98T/S143A/E266G | +++ |
| 1751/1752 | S143A/E266G/S296N/S297A | +++ |
| 1753/1754 | K29P/G98T/K185R/E266G/ S296N/N299G | +++ |
| 1755/1756 | G98T/S143A/S162A/E266G | +++ |
| 1757/1758 | G98T/S143A/K185R/E266G | +++ |
| 1759/1760 | K29P/K170R/K185R/L193S/ E266G/N299G | +++ |
| 1761/1762 | S143A/K158R/N197E/E266G | +++ |
| 1763/1764 | K29P/K158R/E266G | +++ |
| 1765/1766 | K29P/S143A/K170R/L193S/ N197E/E266G | +++ |
| 1767/1768 | R182G | +++ |
| 1769/1770 | G98A/K185R/L193S/N197E/ E266G/S297A | ++ |

TABLE 34.2-continued

| SEQ ID NO: (nt/aa) | Amino Acid Differences (Relative to SEQ ID NO: 1700) | FIOP Product Peak Area Relative to SEQ ID NO: 1700 |
|---|---|---|
| 1771/1772 | K29P/G98A/K185R/N197E/E266G | ++ |
| 1773/1774 | S143A | ++ |
| 1775/1776 | K29P | ++ |
| 1777/1778 | R28G/Q92E/F147Y/P204I/Q290R/K303G | ++ |
| 1779/1780 | K29P/S143A | ++ |
| 1781/1782 | R28G/Q92E/E156D/P204L/Q290R | ++ |
| 1783/1784 | R28E/P84E/E156D/F173L/P204M/Q290R/K303G | ++ |
| 1785/1786 | F147Y/Q290R/K303T/A307V | ++ |
| 1787/1788 | K170R/L193S/N197E | ++ |
| 1789/1790 | G98A/K185R | ++ |
| 1791/1792 | R28G/P84E/F173L/P204R/K303T | ++ |
| 1793/1794 | K29P/S143A/S162A | ++ |
| 1795/1796 | P84E/F173L/P204F/K303T | ++ |
| 1797/1798 | R28E/Q290R | ++ |
| 1799/1800 | Q92E/F173L/P204F/Q290V/K303G | ++ |
| 1801/1802 | R28E/P84E/Q92E/F147Y/P204R | ++ |
| 1803/1804 | R28E/Q92E/F147Y | + |
| 1805/1806 | E266G/S297A/N299G | + |
| 1807/1808 | R28G/Q92E/P204R | + |
| 1809/1810 | R28G/P204R | + |
| 1811/1812 | R28E/P84E/F173L/K303G | + |
| 1813/1814 | F173L/P204F/K303G | + |
| 1815/1816 | R28G/K303G | + |
| 1817/1818 | R28G/F147Y/K303G | + |
| 1819/1820 | F173L/P204R | + |
| 1821/1822 | P84E/Q92E/F173L | + |
| 1823/1824 | G98T/S162A/L193V | + |
| 1825/1826 | G98T/S143A/K158R/K170R/K185R/S296N/S297A | + |
| 1827/1828 | P18Q/R28G/F147Y/K303G | + |
| 1829/1830 | K72R | + |
| 1831/1832 | K29P/K185R/S296N | + |
| 1833/1834 | F173L | + |
| 1835/1836 | R28E/P84E | + |
| 1837/1838 | G98T/K170R/L193S/N197E | + |
| 1839/1840 | R28G/P84E/K303G | + |
| 1841/1842 | P84E | + |
| 1843/1844 | R28G | + |
| 1845/1846 | K303G | + |
| 1847/1848 | P204R | + |
| 1849/1850 | P84E/E156D/F173L/P204F | + |
| 1851/1852 | R28G/E156D/P204I | + |
| 1853/1854 | R28G/P84E/F147Y/P204L | + |
| 1855/1856 | K29P/L193V/N197E/S296N/S297A | + |
| 1857/1858 | G98T | + |

Levels of increased activity were determined relative to the reference polypeptide of SEQ ID NO: 1700 and defined as follows: "+" 1.35 to 3.00, "++" >3.00, "+++" >15.00

Example 35

Improvements Over SEQ ID NO: 1700 in the Extension of Oligonucleotide Acceptor Molecules with Nucleotide Triphosphate Donors HTP Screening for Improved TdT Variants SEQ ID NO: 1700 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 35.1.

Reactions were performed in 96-well format 200 µL BioRad PCR plates. Reactions included 1-4 µM oligonucleotide, 25-200 µM nucleotide triphosphate, 0.002 Unit/µL yeast pyrophosphatase (Thermo Scientific), 20 mM buffer, 50 mM potassium acetate, and 250 µM cobalt (II) chloride. The reactions were set up as follows: (i) all reaction components, except for TdT, were pre-mixed in a single solution, and 15 µL of this solution was aliquoted into each well of the 96-well plates (ii) 5 µL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 35.1. The quenched reactions were centrifuged at 4,000 rpm for 10 min at 4° C. to pellet any precipitate. Supernatant was then transferred into new HTP plates for analytical analysis as described in Table 35.1.

TABLE 35.1

| All lysis, purification, reaction, quench, and analytical properties |
|---|
| Lysis and purification conditions: Lysis buffer-20 mM Tris-acetate, pH 8, 0.2 g/L lysozyme from chicken egg white; Lysis buffer volume-300 µL; Lysate pre-treatment-Lysates were preincubated at 45° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide-4 µM TTTTTTTATC; Nucleotide triphosphate-50 µM 3'PO4-dTTP; Reaction buffer-20 mM MOPS, pH 7.2, 0.002 Unit/µL yeast pyrophosphatase (Thermo Scientific), 50 mM potassium acetate, 250 µM cobalt (II) chloride; Reaction volume-36 µL; Lysate dilution-None; Reaction temperature-45° C.; Reaction time-15 minutes |
| Quench conditions: Quench solution and volume-Reactions were quenched by adding two volumes of 90% acetonitrile and 10% methanol mixture and clarifying by centrifugation; Plate type and seal-384-well microtiter plate with a foil seal |
| Analytical conditions: Instrument-Agilent RapidFire SPE-MS/MS-see Example 6; Reaction product detected-TTTTTTTATCT-3'PO4 |

Activity relative to SEQ ID NO: 1700 (Activity FIOP) was calculated as the product peak area of the variant compared with the product peak area observed by the reaction with SEQ ID NO: 1700 (where the peak area may be set as the average of replicates or else the highest single sample as appropriate). The results are shown in Table 35.2.

TABLE 35.2

| SEQ ID NO: (nt/aa) | Amino Acid Differences (Relative to SEQ ID NO: 1700) | FIOP Product Peak Area Relative to SEQ ID NO: 1700 |
|---|---|---|
| 1767/1768 | R182G | +++ |
| 1859/1860 | E266G | +++ |
| 1861/1862 | K72Q | +++ |
| 1863/1864 | R345K | +++ |
| 1865/1866 | I224V | +++ |
| 1867/1868 | R182N | +++ |
| 1869/1870 | K29P | +++ |
| 1871/1872 | K72S | ++ |
| 1873/1874 | R182W | ++ |
| 1875/1876 | R182Q | ++ |
| 1877/1878 | R182Y | ++ |
| 1879/1880 | K72G | ++ |
| 1881/1882 | K338G | ++ |
| 1883/1884 | R345I | ++ |
| 1885/1886 | K60T | ++ |
| 1887/1888 | R182F | ++ |
| 1889/1890 | I224T | ++ |
| 1891/1892 | K338A | + |
| 1893/1894 | P84E | + |
| 1895/1896 | R182S | + |
| 1897/1898 | R182A | + |
| 1899/1900 | I224A | + |
| 1901/1902 | T211V | + |
| 1903/1904 | T211A | + |
| 1905/1906 | F147Y | + |
| 1907/1908 | Q290R | + |
| 1909/1910 | K72W | + |
| 1911/1912 | M220Y | + |
| 1913/1914 | M220L | + |
| 1915/1916 | M220S | + |
| 1917/1918 | M220V | + |
| 1919/1920 | R342A | + |
| 1921/1922 | I224C | + |

TABLE 35.2-continued

| SEQ ID NO: (nt/aa) | Amino Acid Differences (Relative to SEQ ID NO: 1700) | FIOP Product Peak Area Relative to SEQ ID NO: 1700 |
|---|---|---|
| 1923/1924 | K72E | + |
| 1925/1926 | E339C | + |

Levels of increased activity were determined relative to the reference polypeptide of SEQ ID NO: 1700 and defined as follows: "+" 1.00 to 1.33, "++" >1.33, "+++" >1.75

Example 36

Improvements Over SEQ ID NO: 1750 in the Extension of Oligonucleotide Acceptor Molecules with Nucleotide Triphosphate Donors HTP Screening for Improved TdT Variants SEQ ID NO: 1750 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 36.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (11) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 36.1. The quenched reactions were centrifuged at 4,000 rpm for 10 min at 4° C. to pellet any precipitate. Supernatant was then transferred into new HTP plates for analytical analysis as described in Table 36.1.

TABLE 36.1

| All lysis, purification, reaction, quench, and analytical properties |
|---|
| Lysis and purification conditions: Lysis buffer-20 mM Tris-acetate, pH 8, 0.2 g/L lysozyme from chicken egg white; Lysis buffer volume-250 μL; Lysate pre-treatment-Lysates were preincubated at 53° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide-4 μM TTTTTTTATC; Nucleotide triphosphate-50 μM 3'PO4-dGTP; Reaction buffer-20 mM MOPS, pH 7.2, 0.002 Unit/μL yeast pyrophosphatase (Thermo Scientific), 50 mM potassium acetate, 250 μM cobalt (II) chloride; Reaction volume-20 μL; Lysate dilution-None; Reaction temperature-53° C.; Reaction time-15 minutes |
| Quench conditions: Quench solution and volume-Reactions were quenched by the addition of 24 μL acetonitrile. The solutions were mixed well and then further diluted by the addition of 16 μL of 20 mM aqueous EDTA.; Plate type and seal-96-well BioRad PCR plate with a plastic seal |
| Analytical conditions: Instrument-Thermo Accela, Thermo LTQ XL-see Example 5; Reaction product detected-TTTTTTTATCG-3'PO4 |

Activity relative to SEQ ID NO: 1750 (Activity FIOP) was calculated as the product peak area of the variant compared with the product peak area observed by the reaction with SEQ ID NO: 1750 (where the peak area may be set as the average of replicates or else the highest single sample as appropriate). The results are shown in Table 36.2.

TABLE 36.2

| SEQ ID NO: (nt/aa) | Amino Acid Differences (Relative to SEQ ID NO: 1750) | FIOP Product Peak Area Relative to SEQ ID NO: 1750 |
|---|---|---|
| 1927/1928 | R364L | +++ |
| 1929/1930 | G9D/E156D/R364L | +++ |
| 1931/1932 | G9D/R364L | +++ |
| 1933/1934 | E156D/K158R/A190V/L193V/R364L | +++ |
| 1935/1936 | G9D/R28E/Q290R/K303G/R364L | +++ |
| 1937/1938 | Q290R/K303G/R364L | +++ |
| 1939/1940 | G9D/E156D/K158R/L193V/Q290R/K303G/R364L | +++ |
| 1941/1942 | R28G/R364L | +++ |
| 1943/1944 | G9D/Q290R/R364L | +++ |
| 1945/1946 | F147Y/I224V | ++ |
| 1947/1948 | G9D/R28G/E156D/K158R/F173L/A190V/L193S/K303G/R364L | ++ |
| 1949/1950 | P14I/P84E/I224V/S296N/N299G | ++ |
| 1951/1952 | P14I/P84E/S162A/I224V/S297A/N299G | ++ |
| 1953/1954 | G9D/R28E/E156D/K158R/Q290R/R364L | ++ |
| 1955/1956 | P14I/I224V/S296N/Y298V | ++ |
| 1957/1958 | F147Y/I224V/S297A/Y298V | ++ |
| 1959/1960 | N58S/F147Y/S162A/N197E/I224V/S296N/S297A/Y298V/N299G | ++ |
| 1961/1962 | P23S/R28E/E156D/K158R/A190V/L193S/Q290R/R364L | ++ |
| 1963/1964 | I224V/S296N/Y298V | ++ |
| 1965/1966 | N58S/I224V/N299G | ++ |
| 1967/1968 | P14I/S162A/I224V/Y298V/N299G | + |
| 1969/1970 | P14I/P84E/F147Y/L193S/N197E/I224V/S296N | + |
| 1971/1972 | P14I/N58S/P84E/F147Y/S162A/I224V/S296N/S297A/Y298V/N299G | + |
| 1973/1974 | R28G/E156D/F173L/R364L | + |
| 1975/1976 | G9D/R28E/A190V/L193S/K303G/R364L | + |
| 1977/1978 | N58S/S162A/I224V/S296N/Y298V | + |
| 1979/1980 | P14I/N58S/P84E/F147Y/S162A/I224V/S296N/S297A/N299G | + |
| 1981/1982 | P14I/N58S/P84E/I224V/Y298V | + |
| 1983/1984 | N58S/I224V | + |
| 1985/1986 | R28E/E156D/F173L/R364L | + |
| 1987/1988 | R28G/A190V/L193V | + |
| 1989/1990 | I224V/S297A/N299G | + |

TABLE 36.2-continued

| SEQ ID NO: (nt/aa) | Amino Acid Differences (Relative to SEQ ID NO: 1750) | FIOP Product Peak Area Relative to SEQ ID NO: 1750 |
|---|---|---|
| 1991/1992 | R28G/K158R/F173L/A190V/L193V/Q290R/R364L | + |
| 1993/1994 | R28G/S296G/K303G/R364L | + |
| 1995/1996 | G9D | + |
| 1997/1998 | K158R/L193V/Q290R/K303G | + |
| 1999/2000 | P14I | + |
| 2001/2002 | P84E/F147Y | + |
| 2003/2004 | L193V/Q290R | + |
| 2005/2006 | K303T | + |

Levels of increased activity were determined relative to the reference polypeptide of SEQ ID NO: 1750 and defined as follows: "+" 1.41 to 2.75, "++" >2.75, "+++" >4.00

Example 37

Improvements Over SEQ ID NO: 1750 in the Extension of Oligonucleotide Acceptor Molecules with Nucleotide Triphosphate Donors HTP Screening for Improved TdT Variants SEQ ID NO: 1750 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 37.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 37.1. The quenched reactions were centrifuged at 4,000 rpm for 10 min at 4° C. to pellet any precipitate. Supernatant was then transferred into new HTP plates for analytical analysis as described in Table 37.1.

TABLE 37.1

| All lysis, purification, reaction, quench, and analytical properties |
|---|
| Lysis and purification conditions: Lysis buffer-20 mM Tris-acetate, pH 8, 0.2 g/L lysozyme from chicken egg white; Lysis buffer volume-300 μL; Lysate pre-treatment-Lysates were preincubated at 52° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide-4 μM TTTTTTTATC; Nucleotide triphosphate-50 μM 3'PO4-dGTP; Reaction buffer-20 mM MOPS, pH 7.2, 0.002 Unit/μL yeast pyrophosphatase (Thermo Scientific), 50 mM potassium acetate, 250 μM cobalt (II) chloride; Reaction volume-36 μL; Lysate dilution-None; Reaction temperature-52° C.; Reaction time-15 minutes |
| Quench conditions: Quench solution and volume-Reactions were quenched by adding two volumes of 90% acetonitrile and 10% methanol mixture and clarifying by centrifugation; Plate type and seal-384-well microtiter plate with a foil seal |
| Analytical conditions: Instrument-Agilent RapidFire SPE-MS/MS-see Example 6; Reaction product detected-TTTTTTTATCG-3'PO4 |

Activity relative to SEQ ID NO: 1750 (Activity FIOP) was calculated as the product peak area of the variant compared with the product peak area observed by the reaction with SEQ ID NO: 1750 (where the peak area may be set as the average of replicates or else the highest single sample as appropriate). The results are shown in Table 37.2.

TABLE 37.2

| SEQ ID NO: (nt/aa) | Amino Acid Differences (Relative to SEQ ID NO: 1750) | FIOP Product Peak Area Relative to SEQ ID NO: 1750 |
|---|---|---|
| 2007/2008 | R364L | +++ |
| 2009/2010 | S34A | +++ |
| 2011/2012 | L78F | ++ |
| 2013/2014 | R364F | ++ |
| 2015/2016 | D237A/R271H | ++ |
| 2017/2018 | F48L | ++ |
| 2019/2020 | I315V | + |
| 2021/2022 | K249T | + |
| 2023/2024 | K302G | + |
| 2025/2026 | K365G | + |
| 2027/2028 | G353Q | + |
| 2029/2030 | L69I | + |
| 2031/2032 | V309K | + |

Levels of increased activity were determined relative to the reference polypeptide of SEQ ID NO: 1750 and defined as follows: "+" 1.19 to 1.75, "++" >1.75, "+++" >2.25

Example 38

Improvements Over SEQ ID NO: 1932 in the Extension of Oligonucleotide Acceptor Molecules with Nucleotide Triphosphate Donors HTP Screening for Improved TdT Variants SEQ ID NO: 1932 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 38.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 38.1. The quenched reactions were centrifuged at 4,000 rpm for 10 min at 4° C. to pellet any precipitate. Supernatant was then transferred into new HTP plates for analytical analysis as described in Table 38.1.

TABLE 38.1

| All lysis, purification, reaction, quench, and analytical properties |
|---|
| Lysis and purification conditions: Lysis buffer-20 mM Tris-acetate, pH 8, 0.2 g/L lysozyme from chicken egg white; Lysis buffer volume-300 μL; Lysate pre-treatment-Lysates were preincubated at 55° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide-4 μM TTTTTTTATC; Nucleotide triphosphate-50 μM 3'PO4-dGTP; Reaction buffer-20 mM MOPS, pH 7.2, 0.002 Unit/μL yeast pyrophosphatase (Thermo Scientific), 50 mM potassium acetate, 250 μM cobalt (II) chloride; Reaction volume-36 μL; Lysate dilution-None; Reaction temperature-55° C.; Reaction time-15 minutes |
| Quench conditions: Quench solution and volume-Reactions were quenched by adding two volumes of 90% acetonitrile and 10% methanol mixture and clarifying by centrifugation; Plate type and seal-384-well microtiter plate with a foil seal |
| Analytical conditions: Instrument-Agilent RapidFire SPE-MS/MS-see Example 6; Reaction product detected-TTTTTTTATCG-3'PO4 |

Activity relative to SEQ ID NO: 1932 (Activity FIOP) was calculated as the product peak area of the variant compared with the product peak area observed by the reaction with SEQ ID NO: 1932 (where the peak area may be set as the average of replicates or else the highest single sample as appropriate). The results are shown in Table 38.2.

TABLE 38.2

| SEQ ID NO: (nt/aa) | Amino Acid Differences (Relative to SEQ ID NO: 1932) | FIOP Product Peak Area Relative to SEQ ID NO: 1932 |
|---|---|---|
| 2033/2034 | I224V/Y298V/N299G | +++ |
| 2035/2036 | P14I/F147Y/I224V | +++ |
| 2037/2038 | P84E/I224V/S297A/Y298V/N299G | +++ |
| 2039/2040 | P14I/F147Y/K158R/S162A/I224V | +++ |
| 2041/2042 | N58D/P84E/T211A/M220V/I224V | +++ |
| 2043/2044 | I224V | +++ |
| 2045/2046 | P14I/I224V/S296N/K303G | +++ |
| 2047/2048 | F147Y/K158R/S162A/A190V/I224V/S296N/S297A/N299G/K303G | +++ |
| 2049/2050 | R28G/I224V/S296N/S297A/Y298V/K303G | +++ |
| 2051/2052 | I66P/M220V/I224V | +++ |
| 2053/2054 | M220V/I224V/I315V | +++ |
| 2055/2056 | P84E/M220V/I315V | +++ |
| 2057/2058 | P14I/K158R/S162A/N197E/I224V/S296N/Y298V/N299G | +++ |
| 2059/2060 | P14I/L193V/N197E/I224V/S297R/Y298W/N299-/T300A | ++ |
| 2061/2062 | P84E/F147Y/N197E/S296N/S297A | ++ |
| 2063/2064 | K72Q | ++ |
| 2065/2066 | P84E/F147Y/S297A/Y298V/K303G | ++ |

TABLE 38.2-continued

| SEQ ID NO: (nt/aa) | Amino Acid Differences (Relative to SEQ ID NO: 1932) | FIOP Product Peak Area Relative to SEQ ID NO: 1932 |
|---|---|---|
| 2067/2068 | R28E/N58S/F147Y/I224V/S296N/S297A/ Y298V/N299G/K303G | ++ |
| 2069/2070 | P14I/R28G/N58S/I224V | ++ |
| 2071/2072 | R28E/N58S/S162A/I224V/Y298V/N299G | ++ |
| 2073/2074 | P84E/F173L/I224V | ++ |
| 2075/2076 | K72Q/T86Q/M220V | ++ |
| 2077/2078 | R28G/P84E/F147Y/S297A/Y298V | ++ |
| 2079/2080 | G353D | ++ |
| 2081/2082 | P14I/R28G/I224V/S296N/Y298V | ++ |
| 2083/2084 | I77L | ++ |
| 2085/2086 | R28E/N58S/P84E/K158R/S162A/L193V/ I224V/S296N/Y298V/N299G | ++ |
| 2087/2088 | N197E | ++ |
| 2089/2090 | G292K | ++ |
| 2091/2092 | L193V/N197E/S296N/K303G | ++ |
| 2093/2094 | V104L | ++ |
| 2095/2096 | V120I | + |
| 2097/2098 | K72G/P84E/T86Q/I224V | + |
| 2099/2100 | P14I/R28G/N58S/S162A/A190V/L193V/ I224V | + |
| 2101/2102 | P14I/F147Y/F173L | + |
| 2103/2104 | P14I/F147Y | + |
| 2105/2106 | S162A/I224V | + |
| 2107/2108 | P14I/F173L/L193V/N197E/S296N/S297A/ Y298V/N299G | + |
| 2109/2110 | N58D/K72Q/T211A/I315V | + |
| 2111/2112 | K72Q/M220V/I224V | + |
| 2113/2114 | P233G | + |
| 2115/2116 | I77V | + |
| 2117/2118 | F147Y | + |
| 2119/2120 | P233R | + |
| 2121/2122 | M220V/I315V | + |
| 2123/2124 | R28G/S296N/Y298V | + |
| 2125/2126 | K72G/P84E/M220V/I224V/I315V | + |
| 2127/2128 | Q100D | + |
| 2129/2130 | K72Q/M220V/I315V | + |
| 2131/2132 | P14I/N58S/K158R/I224V | + |
| 2133/2134 | F173L | + |
| 2135/2136 | A190V/L193V/N197E | + |
| 2137/2138 | R367K | + |
| 2139/2140 | R28G | + |
| 2141/2142 | P14I/N58S/S162A | + |
| 2143/2144 | H12L | + |
| 2145/2146 | P14I/N58S/F147Y/S162A/A190V/L193V/ I224V/S296N/K303G | + |
| 2147/2148 | N58D/K72Q/M220V/I224V | + |
| 2149/2150 | N58S/F147Y/S162A/S296N/Y298V | + |

TABLE 38.2-continued

| SEQ ID NO: (nt/aa) | Amino Acid Differences (Relative to SEQ ID NO: 1932) | FIOP Product Peak Area Relative to SEQ ID NO: 1932 |
|---|---|---|
| 2151/2152 | P14I | + |
| 2153/2154 | S297A | + |
| 2155/2156 | I315V | + |
| 2157/2158 | P14I/R28G/N58S/P84E/F173L/S297A | + |
| 2159/2160 | R28G/P84E | + |
| 2161/2162 | A75V | + |

Levels of increased activity were determined relative to the reference polypeptide of SEQ ID NO: 1932 and defined as follows: "+" 1.25 to 1.60, "++" >1.60, "+++" >2.25

Example 39

Improvements Over SEQ ID NO: 1932 in the Extension of Oligonucleotide Acceptor Molecules with Nucleotide Triphosphate Donors HTP Screening for Improved TdT Variants SEQ ID NO: 1932 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 39.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (11) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 39.1. The quenched reactions were centrifuged at 4,000 rpm for 10 min at 4° C. to pellet any precipitate. Supernatant was then transferred into new HTP plates for analytical analysis as described in Table 39.1.

TABLE 39.1

All lysis, purification, reaction, quench, and analytical properties

Lysis and purification conditions: Lysis buffer-20 mM Tris-acetate, pH 8, 0.2 g/L lysozyme from chicken egg white; Lysis buffer volume-300 μL; Lysate pre-treatment-Lysates were preincubated at 55° C. for one hour, then centrifuged at 4,000 rpm for 10 min as described in Example 2 [Lysis of HTP Cell Pellets with Lysozyme]. The clarified supernatants were used in reactions.

Reaction conditions: Oligonucleotide-4 μM TTTTTTTATC; Nucleotide triphosphate-50 μM 3'PO4-dGTP; Reaction buffer-20 mM MOPS, pH 7.2, 0.002 Unit/μL yeast pyrophosphatase (Thermo Scientific), 50 mM potassium acetate, 250 μM cobalt (II) chloride; Reaction volume-36 μL; Lysate dilution-None; Reaction temperature-55° C.; Reaction time-15 minutes Quench conditions: Quench solution and volume-Reactions were quenched by adding two volumes of 90% acetonitrile and 10% methanol mixture and clarifying by centrifugation; Plate type and seal-384-well microtiter plate with a foil seal Analytical conditions: Instrument-Agilent RapidFire SPE-MS/MS-see Example 6; Reaction product detected-TTTTTTTATCG-3'PO4

Activity relative to SEQ ID NO: 1932 (Activity FIOP) was calculated as the product peak area of the variant compared with the product peak area observed by the reaction with SEQ ID NO: 1932 (where the peak area may be set as the average of replicates or else the highest single sample as appropriate). The results are shown in Table 39.2.

TABLE 39.2

| SEQ ID NO: (nt/aa) | Amino Acid Differences (Relative to SEQ ID NO: 1932) | FIOP Product Peak Area Relative to SEQ ID NO: 1932 |
|---|---|---|
| 2079/2080 | G353D | +++ |
| 2083/2084 | I77L | +++ |
| 2087/2088 | N197E | ++ |
| 2089/2090 | G292K | ++ |
| 2093/2094 | V104L | ++ |
| 2095/2096 | V120I | ++ |
| 2113/2114 | P233G | ++ |
| 2115/2116 | I77V | + |
| 2119/2120 | P233R | + |
| 2127/2128 | Q100D | + |
| 2137/2138 | R367K | + |
| 2143/2144 | H12L | + |
| 2161/2162 | A75V | + |

Levels of increased activity were determined relative to the reference polypeptide of SEQ ID NO: 1932 and defined as follows: "+" 1.25 to 1.50, "++" >1.50, "+++" >1.65

Example 40

Improvements Over SEQ ID NO: 2164 in the Extension of Oligonucleotide Acceptor Molecules with Nucleotide Triphosphate Donors HTP Screening for Improved TdT Variants SEQ ID NO: 2164 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 40.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 40.1. The quenched reactions were centrifuged at 4,000 rpm for 10 min at 4° C. to pellet any precipitate. Supernatant was then transferred into new HTP plates for analytical analysis as described in Table 40.1.

TABLE 40.1

| All lysis, purification, reaction, quench, and analytical properties |
|---|
| Lysis and purification conditions: Lysis buffer-20 mM Tris-acetate, pH 8, 0.2 g/L lysozyme from chicken egg white; Lysis buffer volume-400 μL; Lysate pre-treatment-Lysates were preincubated at 50° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide-4 μM TTTTTTTATC; Nucleotide triphosphate-50 μM 3'PO4-dGTP; Reaction buffer-20 mM MOPS, pH 7.2, 0.002 Unit/μL yeast pyrophosphatase (Thermo Scientific), 50 mM potassium acetate, 250 μM cobalt (II) chloride; Reaction volume-36 μL; Lysate dilution-4× dilution prior to adding to the reaction; Reaction temperature-50° C.; Reaction time-15 minutes |
| Quench conditions: Quench solution and volume-Reactions were quenched by adding two volumes of 90% acetonitrile and 10% methanol mixture and clarifying by centrifugation; Plate type and seal-384-well microtiter plate with a foil seal |
| Analytical conditions: Instrument-Agilent RapidFire SPE-MS/MS-see Example 6; Reaction product detected-TTTTTTTATCG-3'PO4 |

Activity relative to SEQ ID NO: 2164 (Activity FIOP) was calculated as the product peak area of the variant compared with the product peak area observed by the reaction with SEQ ID NO: 2164 (where the peak area may be set as the average of replicates or else the highest single sample as appropriate). The results are shown in Table 40.2.

TABLE 40.2

| SEQ ID NO: (nt/aa) | Amino Acid Differences (Relative to SEQ ID NO: 2164) | FIOP Product Peak Area Relative to SEQ ID NO: 2164 |
|---|---|---|
| 2165/2166 | L52V | + |
| 2167/2168 | I66S | + |
| 2169/2170 | I66E | + |
| 2171/2172 | A51V | + |
| 2173/2174 | A71M | + |

Levels of increased activity were determined relative to the reference polypeptide of SEQ ID NO: 2164 and defined as follows: "+" 1.00 to 1.18

Example 41

Improvements Over SEQ ID NO: 2164 in the Extension of Oligonucleotide Acceptor Molecules with Nucleotide Triphosphate Donors HTP Screening for Improved TdT Variants SEQ ID NO: 2164 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 41.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 41.1. The quenched reactions were centrifuged at 4,000 rpm for 10 min at 4° C. to pellet any precipitate. Supernatant was then transferred into new HTP plates for analytical analysis as described in Table 41.1.

TABLE 41.1

| All lysis, purification, reaction, quench, and analytical properties |
|---|
| Lysis and purification conditions: Lysis buffer-20 mM Tris-acetate, pH 8, 0.2 g/L lysozyme from chicken egg white; Lysis buffer volume-400 μL; Lysate pre-treatment-Lysates were preincubated at 58° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide-4 μM TTTTTTTATC; Nucleotide triphosphate-50 μM 3'PO4-dTTP; Reaction buffer-20 mM MOPS, pH 7.2, 0.002 Unit/μL yeast pyrophosphatase (Thermo Scientific), 50 mM potassium acetate, 250 μM cobalt (II) chloride; Reaction volume-36 μL; Lysate dilution-None; Reaction temperature-58° C.; Reaction time-15 minutes |
| Quench conditions: Quench solution and volume-Reactions were quenched by adding two volumes of 90% acetonitrile and 10% methanol mixture and clarifying by centrifugation; Plate type and seal-384-well microtiter plate with a foil seal |
| Analytical conditions: Instrument-Agilent RapidFire SPE-MS/MS-see Example 6; Reaction product detected-TTTTTTTATCT-3'PO4 |

Activity relative to SEQ ID NO: 2164 (Activity FIOP) was calculated as the product peak area of the variant compared with the product peak area observed by the reaction with SEQ ID NO: 2164 (where the peak area may be set as the average of replicates or else the highest single sample as appropriate). The results are shown in Table 41.2.

TABLE 41.2

| SEQ ID NO: (nt/aa) | Amino Acid Differences (Relative to SEQ ID NO: 2164) | FIOP Product Peak Area Relative to SEQ ID NO: 2164 |
|---|---|---|
| 2175/2176 | A328W | +++ |
| 2177/2178 | A380S | +++ |
| 2179/2180 | Y80S | +++ |
| 2181/2182 | G9D/G11L | +++ |
| 2183/2184 | R200L | +++ |
| 2185/2186 | A206V | +++ |
| 2187/2188 | V264T | +++ |
| 2189/2190 | I108D | +++ |
| 2191/2192 | G20V | +++ |
| 2193/2194 | S304L | ++ |
| 2195/2196 | L78M | ++ |
| 2197/2198 | E350L | ++ |
| 2199/2200 | R116P | ++ |
| 2201/2202 | K249A | ++ |
| 2203/2204 | L52G | ++ |
| 2205/2206 | I378G | ++ |
| 2207/2208 | G20K | ++ |
| 2209/2210 | F324V | ++ |
| 2211/2212 | L361W | ++ |
| 2213/2214 | S374D | ++ |
| 2215/2216 | G20E | ++ |
| 2217/2218 | E235V | ++ |
| 2219/2220 | V101C | ++ |
| 2221/2222 | E235M | ++ |
| 2223/2224 | E111R | ++ |
| 2225/2226 | F147M | ++ |
| 2227/2228 | K249G | ++ |
| 2229/2230 | E308L | ++ |
| 2231/2232 | G232M | ++ |
| 2233/2234 | S304G | + |
| 2235/2236 | R200I | + |
| 2237/2238 | I368R | + |
| 2239/2240 | E111F | + |
| 2241/2242 | E350T | + |
| 2243/2244 | K145R | + |
| 2245/2246 | L203S | + |
| 2247/2248 | E235F | + |
| 2249/2250 | K145C | + |
| 2251/2252 | A74L | + |
| 2253/2254 | K242R | + |
| 2255/2256 | Q267S | + |
| 2257/2258 | E235C | + |
| 2259/2260 | V293D | + |
| 2261/2262 | G20R | + |
| 2263/2264 | F173R | + |
| 2265/2266 | V293G | + |
| 2267/2268 | M306P | + |
| 2269/2270 | R352A | + |
| 2271/2272 | K145V | + |
| 2273/2274 | C96A | + |
| 2275/2276 | E235R | + |
| 2277/2278 | G20L | + |
| 2279/2280 | L288R | + |
| 2281/2282 | Q326C | + |
| 2283/2284 | R116L | + |
| 2285/2286 | L203V | + |

Levels of increased activity were determined relative to the reference polypeptide of SEQ ID NO: 2164 and defined as follows: "+" 1.11 to 1.25, "++" >1.25, "+++" >1.50

Example 42

Improvements Over SEQ ID NO: 2164 in the Extension of Oligonucleotide Acceptor Molecules with Nucleotide Triphosphate Donors HTP Screening for Improved TdT Variants SEQ ID NO: 2164 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 42.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 42.1. The quenched reactions were centrifuged at 4,000 rpm for 10 min at 4° C. to pellet any precipitate. Supernatant was then transferred into new HTP plates for analytical analysis as described in Table 42.1.

TABLE 42.1

| All lysis, purification, reaction, quench, and analytical properties |
|---|
| Lysis and purification conditions: Lysis buffer-20 mM Tris-acetate, pH 8, 0.2 g/L lysozyme from chicken egg white; Lysis buffer volume-400 μL; Lysate pre-treatment-Lysates were preincubated at 48° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide-4 μM TTTTTTTATC; Nucleotide triphosphate-50 μM 3'PO4-dCTP; Reaction buffer-20 mM MOPS, pH 7.2, 0.002 Unit/μL yeast pyrophosphatase (Thermo Scientific), 50 mM potassium acetate, 250 μM cobalt (II) chloride; Reaction volume-20 μL; Lysate dilution-2× dilution prior to adding to the reaction; Reaction temperature-48° C.; Reaction time-15 minutes |
| Quench conditions: Quench solution and volume-Reactions were quenched by the addition of 24 μL acetonitrile. The solutions were mixed well and then further diluted by the addition of 16 μL of 20 mM aqueous EDTA.; Plate type and seal-96-well BioRad PCR plate with a plastic seal |
| Analytical conditions: Instrument-Agilent UHPLC 1260 prime series, Agilent Ultivo-see Example 4; Reaction product detected-TTTTTTTATCC-3'PO4 |

Activity relative to SEQ ID NO: 2164 (Activity FIOP) was calculated as the product peak area of the variant compared with the product peak area observed by the reaction with SEQ ID NO: 2164 (where the peak area may be set as the average of replicates or else the highest single sample as appropriate). The results are shown in Table 42.2.

TABLE 42.2

| SEQ ID NO: (nt/aa) | Amino Acid Differences (Relative to SEQ ID NO: 2164) | FIOP Product Peak Area Relative to SEQ ID NO: 2164 |
|---|---|---|
| 2287/2288 | M276L | +++ |
| 2289/2290 | K259Q | ++ |
| 2291/2292 | I273V | ++ |
| 2293/2294 | I97L | + |
| 2295/2296 | K259V | + |
| 2297/2298 | M168Q | + |
| 2299/2300 | M168A | + |

Levels of increased activity were determined relative to the reference polypeptide of SEQ ID NO: 2164 and defined as follows: "+" 0.95 to 1.00, "++" >1.00, "+++" >1.10

Example 43

Improvements Over SEQ ID NO: 2164 in the Extension of Oligonucleotide Acceptor Molecules with Nucleotide Triphosphate Donors HTP Screening for Improved TdT Variants SEQ ID NO: 2164 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 43.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 43.1. The quenched reactions were centrifuged at 4,000 rpm for 10 min at 4° C. to pellet any precipitate. Supernatant was then transferred into new HTP plates for analytical analysis as described in Table 43.1.

TABLE 43.1

| All lysis, purification, reaction, quench, and analytical properties |
|---|
| Lysis and purification conditions: Lysis buffer-20 mM Tris-acetate, pH 8, 0.2 g/L lysozyme from chicken egg white; Lysis buffer volume-400 μL; Lysate pre-treatment-Lysates were preincubated at 48° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide-4 μM TTTTTTTATG; Nucleotide triphosphate-50 μM 3'PO4-dTTP; Reaction buffer-20 mM MOPS, pH 7.2, 0.002 Unit/μL yeast pyrophosphatase (Thermo Scientific), 50 mM potassium acetate, 250 μM cobalt (II) chloride; Reaction volume-20 μL; Lysate dilution-2× dilution prior to adding to the reaction; Reaction temperature-48° C.; Reaction time-15 minutes |
| Quench conditions: Quench solution and volume-Reactions were quenched by the addition of 24 μL acetonitrile. The solutions were mixed well and then further diluted by the addition of 16 μL of 20 mM aqueous EDTA.; Plate type and seal-96-well BioRad PCR plate with a plastic seal |
| Analytical conditions: Instrument-Agilent UHPLC 1260 prime series, Agilent Ultivo-see Example 4; Reaction product detected-TTTTTTTATGT-3'PO4 |

Activity relative to SEQ ID NO: 2164 (Activity FIOP) was calculated as the product peak area of the variant compared with the product peak area observed by the reaction with SEQ ID NO: 2164 (where the peak area may be set as the average of replicates or else the highest single sample as appropriate). The results are shown in Table 43.2.

TABLE 43.2

| SEQ ID NO: (nt/aa) | Amino Acid Differences (Relative to SEQ ID NO: 2164) | FIOP Product Peak Area Relative to SEQ ID NO: 2164 |
|---|---|---|
| 2301/2302 | N278A | +++ |
| 2303/2304 | I97L | ++ |
| 2305/2306 | V135I | ++ |
| 2307/2308 | K259Q | ++ |
| 2309/2310 | M276L | + |
| 2311/2312 | I273V | + |
| 2313/2314 | K259V | + |

Levels of increased activity were determined relative to the reference polypeptide of SEQ ID NO: 2164 and defined as follows: "+" 1.07 to 1.21, "++" >1.21, "+++" >1.40

Example 44

Improvements Over SEQ ID NO: 2164 in the Extension of Oligonucleotide Acceptor Molecules with Nucleotide Triphosphate Donors HTP Screening for Improved TdT Variants SEQ ID NO: 2164 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 44.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (11) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 44.1. The quenched reactions were centrifuged at 4,000 rpm for 10 min at 4° C. to pellet any precipitate. Supernatant was then transferred into new HTP plates for analytical analysis as described in Table 44.1.

TABLE 44.1

| All lysis, purification, reaction, quench, and analytical properties |
|---|
| Lysis and purification conditions: Lysis buffer-20 mM Tris-acetate, pH 8, 0.2 g/L lysozyme from chicken egg white; Lysis buffer volume-400 μL; Lysate pre-treatment-Lysates were preincubated at 48° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide-4 μM TTTTTTTACA; Nucleotide triphosphate-50 μM 3'P04-dGTP; Reaction buffer-20 mM MOPS, pH 7.2, 0.002 Unit/μL yeast pyrophosphatase (Thermo Scientific), 50 mM potassium acetate, 250 μM cobalt (II) chloride; Reaction volume-20 μL; Lysate dilution-2× dilution prior to adding to the reaction; Reaction temperature-48° C.; Reaction time-15 minutes |
| Quench conditions: Quench solution and volume-Reactions were quenched by the addition of 24 μL acetonitrile. The solutions were mixed well and then further diluted by the addition of 16 μL of 20 mM aqueous EDTA.; Plate type and seal-96-well BioRad PCR plate with a plastic seal |
| Analytical conditions: Instrument-Agilent UHPLC 1260 prime series, Agilent Ultivo-see Example 4; Reaction product detected-TTTTTTTACAG-3'PO4 |

Activity relative to SEQ ID NO: 2164 (Activity FIOP) was calculated as the product peak area of the variant compared with the product peak area observed by the min at 4° C. to pellet any precipitate. Supernatant was then transferred into new HTP plates for analytical analysis as described in Table 45.1.

TABLE 45.1

| All lysis, purification, reaction, quench, and analytical properties |
| --- |
| Lysis and purification conditions: Lysis buffer—20 mM Tris-acetate, pH 8, 0.2 g/L lysozyme from chicken egg white; Lysis buffer volume—400 µL; Lysate pre-treatment—Lysates were preincubated at 48° C. for one hour, then centrifuged at 4,000 rpm for 10 min as described in Example 2 [Lysis of HTP Cell Pellets with Lysozyme]. The clarified supernatants were used in reactions. Reaction conditions: Oligonucleotide—4 µM TTTTTTTATG; Nucleotide triphosphate—50 µM 3'PO4-dATP; Reaction buffer—20 mM MOPS, pH 7.2, 0.002 Unit/µL yeast pyrophosphatase (Thermo Scientific), 50 mM potassium acetate, 250 µM cobalt (II) chloride; Reaction volume—20 µL; Lysate dilution—2x dilution prior to adding to the reaction; Reaction temperature—48° C.; Reaction time—15 minutes Quench conditions: Quench solution and volume—Reactions were quenched by the addition of 24 µL acetonitrile. The solutions were mixed well and then further diluted by the addition of 16 µL of 20 mM aqueous EDTA.; Plate type and seal—96-well BioRad PCR plate with a plastic seal Analytical conditions: Instrument—Agilent UHPLC 1260 prime series, Agilent Ultivo—see Example 4; Reaction product detected—TTTTTTTATGA-3'PO4 |

reaction with SEQ ID NO: 2164 (where the peak area may be set as the average of replicates or else the highest single sample as appropriate). The results are shown in Table 44.2.

TABLE 44.2

| SEQ ID NO: (nt/aa) | Amino Acid Differences (Relative to SEQ ID NO: 2164) | FIOP Product Peak Area Relative to SEQ ID NO: 2164 |
| --- | --- | --- |
| 2315/2316 | S166T | + |
| 2317/2318 | N278A | + |
| 2319/2320 | I273V | + |
| 2321/2322 | V135I | + |
| 2323/2324 | I97L | + |

Levels of increased activity were determined relative to the reference polypeptide of SEQ ID NO: 2164 and defined as follows: "+" 1.08 to 1.30

Example 45

Improvements Over SEQ ID NO: 2164 in the Extension of Oligonucleotide Acceptor Molecules with Nucleotide Triphosphate Donors HTP Screening for Improved TdT Variants SEQ ID NO: 2164 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 45.1.

Reactions were performed in 96-well format 200 µL BioRad PCR plates. Reactions included 1-4 µM oligonucleotide, 25-200 µM nucleotide triphosphate, 0.002 Unit/µL yeast pyrophosphatase (Thermo Scientific), 20 mM buffer, 50 mM potassium acetate, and 250 µM cobalt (II) chloride. The reactions were set up as follows: (i) all reaction components, except for TdT, were pre-mixed in a single solution, and 15 µL of this solution was aliquoted into each well of the 96-well plates (ii) 5 µL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 45.1. The quenched reactions were centrifuged at 4,000 rpm for 10

Activity relative to SEQ ID NO: 2164 (Activity FIOP) was calculated as the product peak area of the variant compared with the product peak area observed by the reaction with SEQ ID NO: 2164 (where the peak area may be set as the average of replicates or else the highest single sample as appropriate). The results are shown in Table 45.2.

TABLE 45.2

| SEQ ID NO: (nt/aa) | Amino Acid Differences (Relative to SEQ ID NO: 2164) | FIOP Product Peak Area Relative to SEQ ID NO: 2164 |
| --- | --- | --- |
| 2325/2326 | K259Q | +++ |
| 2327/2328 | I273V | +++ |
| 2329/2330 | I97F | +++ |
| 2331/2332 | N230H | +++ |
| 2333/2334 | N278A | ++ |
| 2335/2336 | K259V | ++ |
| 2337/2338 | K167R | ++ |
| 2339/2340 | V140L | + |
| 2341/2342 | S166N | + |
| 2343/2344 | I97L | + |
| 2345/2346 | M276L | + |
| 2347/2348 | V135I | + |
| 2349/2350 | M168Q | + |
| 2351/2352 | N278R | + |

Levels of increased activity were determined relative to the reference polypeptide of SEQ ID NO: 2164 and defined as follows: "+" 1.01 to 1.25, "++" >1.25, "+++" >1.35

Example 46

Improvements Over SEQ ID NO: 2164 in the Extension of Oligonucleotide Acceptor Molecules with Nucleotide Triphosphate Donors HTP Screening for Improved TdT Variants SEQ ID NO: 2164 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 46.1.

Reactions were performed in 96-well format 200 µL BioRad PCR plates. Reactions included 1-4 µM oligonucleotide, 25-200 µM nucleotide triphosphate, 0.002 Unit/µL yeast pyrophosphatase (Thermo Scientific), 20 mM buffer, 50 mM potassium acetate, and 250 µM cobalt (II) chloride.

The reactions were set up as follows: (i) all reaction components, except for TdT, were pre-mixed in a single solution, and 15 µL of this solution was aliquoted into each well of the 96-well plates (ii) 5 µL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 46.1. The quenched reactions were centrifuged at 4,000 rpm for 10 min at 4° C. to pellet any precipitate. Supernatant was then transferred into new HTP plates for analytical analysis as described in Table 46.1.

TABLE 46.1

| All lysis, purification, reaction, quench, and analytical properties |
|---|
| Lysis and purification conditions: Lysis buffer—20 mM Tris-acetate, pH 8, 0.2 g/L lysozyme from chicken egg white; Lysis buffer volume—400 µL; Lysate pre-treatment—Lysates were preincubated at 58° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide—4 µM TTTTTTTATC; Nucleotide triphosphate—50 µM 3'PO4-dTTP; Reaction buffer—20 mM MOPS, pH 7.2, 0.002 Unit/µL yeast pyrophosphatase (Thermo Scientific), 50 mM potassium acetate, 250 µM cobalt (II) chloride; Reaction volume—36 µL; Lysate dilution—None; Reaction temperature—58° C.; Reaction time—15 minutes |
| Quench conditions: Quench solution and volume—Reactions were quenched by adding two volumes of 90% acetonitrile and 10% methanol mixture and clarifying by centrifugation; Plate type and seal—384-well microtiter plate with a foil seal |
| Analytical conditions: Instrument—Agilent RapidFire SPE-MS/MS—see Example 6; Reaction product detected—TTTTTTTATCT-3'PO4 |

Activity relative to SEQ ID NO: 2164 (Activity FIOP) was calculated as the product peak area of the variant compared with the product peak area observed by the reaction with SEQ ID NO: 2164 (where the peak area may be set as the average of replicates or else the highest single sample as appropriate). The results are shown in Table 46.2.

TABLE 46.2

| SEQ ID NO: (nt/aa) | Amino Acid Differences (Relative to SEQ ID NO: 2164) | FIOP Product Peak Area Relative to SEQ ID NO: 2164 |
|---|---|---|
| 2353/2354 | S34A/L78F/F147Y/R182M/P233R/R271H/E339Q | +++ |
| 2355/2356 | S34A/F147Y/R182G/R345K | +++ |
| 2357/2358 | L78F/F147Y/R182M/E339Q/R345K | +++ |
| 2359/2360 | F147Y/G232N/P233G/R271H/I315V/E339Q | +++ |
| 2361/2362 | S34A/F48L/F147Y/K158R/R182M/M220V/P233R/A307G | +++ |
| 2363/2364 | S34A/F147Y/I315V/E339Q | +++ |
| 2365/2366 | S34A/F147Y/R182M/K249T/A307G/I315V/E339Q | +++ |
| 2367/2368 | S34A/K158R/R182G/I315V/E339Q/R345K | +++ |
| 2369/2370 | S34A/F147Y/R182M/I315V | +++ |
| 2371/2372 | F48L/L78F/K158R/R182G/M220V/P233G/K249T | +++ |
| 2373/2374 | F147Y/R182M/M220V/P233R/R345K | +++ |
| 2375/2376 | F147Y/K158R/R182M/P233R/I315V/R345K | +++ |
| 2377/2378 | S34A/L78F/R182M/P233R/A307G | +++ |
| 2379/2380 | S34A/L78F/K158R/R182M/I315V/R345K | +++ |
| 2381/2382 | S34A/F48L/L78F/F147Y/R182M/M220V/P233G/K249T/A307G/I315V/E339Q | +++ |
| 2383/2384 | F147Y/K158R/R182M/N230L/P233R/K249T/R271H/E339Q | +++ |
| 2385/2386 | F48L/F147Y/K158R/R182G/M220V/K249T/A307G/E339Q | +++ |
| 2387/2388 | S34A/F147Y/R182G/P233G/R271H/E339Q | +++ |
| 2389/2390 | S34A/F147Y/R182M/M220V/R271H/I315V | +++ |
| 2391/2392 | S34A/K158R/A307G | +++ |
| 2393/2394 | F147Y/R182M/K249T/R271H/A307G | +++ |
| 2395/2396 | S34A/R182M/N230L/I315V | +++ |
| 2397/2398 | S34A | +++ |
| 2399/2400 | L78F/F147Y/K158R/R182M | +++ |
| 2401/2402 | F48L/F147Y/K158R/R182M/P233G/R345K | +++ |
| 2403/2404 | S34A/L78F/M220V/A307G/E339Q | +++ |
| 2405/2406 | S34A/I315V/R345K | +++ |
| 2407/2408 | S34A/L78F | +++ |
| 2409/2410 | S34A/M220V/A307G/R345K | +++ |
| 2411/2412 | S34A/F147Y/K158R/R182G/K249T/R271H | ++ |
| 2413/2414 | F147Y/K158R/R182G/P233G/A307G/E339Q | ++ |
| 2415/2416 | S34A/R182G/R345K | ++ |
| 2417/2418 | S34A/F48L/L78F/F147Y/K158R | ++ |
| 2419/2420 | F48L/F147Y/K158R/R182G/N230L/P233G | ++ |
| 2421/2422 | F147Y/K158R/R182M/P233R/K249T | ++ |
| 2423/2424 | L78F/F147Y/K249T/R271H/E339Q | ++ |

TABLE 46.2-continued

| SEQ ID NO: (nt/aa) | Amino Acid Differences (Relative to SEQ ID NO: 2164) | FIOP Product Peak Area Relative to SEQ ID NO: 2164 |
|---|---|---|
| 2425/2426 | S34A/F48L/L78F/K158R/R182M/M220V/K249T/A307G | ++ |
| 2427/2428 | S34A/F147Y/K158R | ++ |
| 2429/2430 | S34A/P233G | ++ |
| 2431/2432 | L78F/R182M/M220V/E339Q | ++ |
| 2433/2434 | F48L/L78F/F147Y/R182M/M220V/I315V | ++ |
| 2435/2436 | S34A/L78F/E84G/F147Y/K158R/R182M/M220V | ++ |
| 2437/2438 | L78F/R182G/R271H/I315V/E339Q | ++ |
| 2439/2440 | K158R/R182G/M220V/N230L/K249T/A307G/E339Q | ++ |
| 2441/2442 | S34A/F48L/R182G/P233G/K249T | ++ |
| 2443/2444 | S34A/K158R/M220V | ++ |
| 2445/2446 | F48L/F147Y/K158R/R182M/M220V/I315V | ++ |
| 2447/2448 | M220V/A307G/E339Q | ++ |
| 2449/2450 | L78F/F147Y/K158R/K249T/A307G/I315V | ++ |
| 2451/2452 | F48L/L78F/F147Y/R182M/M220V/P233G/K249T/ E339Q/R345K | ++ |
| 2453/2454 | S34A/F147Y/R182M | ++ |
| 2455/2456 | S34A/F147Y/R182G/M220V | ++ |
| 2457/2458 | F147Y/R182M/P233G/K249T | ++ |
| 2459/2460 | S34A/F48L/L78F/R182G/M220V/N230L/I315V | ++ |
| 2461/2462 | S34A/M220V/I315V/E339Q | ++ |
| 2463/2464 | L78F/F147Y/R182G/K249T/A307G | ++ |
| 2465/2466 | S34A/F147Y/K249T | ++ |
| 2467/2468 | S34A/F147Y/P233R | ++ |
| 2469/2470 | F147Y/K158R/R182M/I315V | ++ |
| 2471/2472 | R182G | ++ |
| 2473/2474 | E339Q | ++ |
| 2475/2476 | S34A/M220V | ++ |
| 2477/2478 | S34A/F147Y/R182M/M220V/N230L/K249T/I315V/ E339Q | ++ |
| 2479/2480 | R182M/N230L | ++ |
| 2481/2482 | F48L/L78F/P233R/I315V/E339Q | ++ |
| 2483/2484 | S34A/R271H/E339Q | ++ |
| 2485/2486 | S34A/M220V/E339Q | ++ |
| 2487/2488 | K249T/I315V/E339Q | ++ |
| 2489/2490 | S34A/L78F/I315V | ++ |
| 2491/2492 | F147Y/R182M/R345K | ++ |
| 2493/2494 | R182G/R345K | ++ |
| 2495/2496 | F147Y | ++ |
| 2497/2498 | F147Y/K158R/R182M/R271H/I315V | ++ |
| 2499/2500 | F147Y/K158R/R182G/M220V/P233G | ++ |
| 2501/2502 | S34A/F147Y/K158R/R182M/P233R | ++ |
| 2503/2504 | F48L/F147Y/P233G/R345K | ++ |
| 2505/2506 | L78F/F147Y/R182M/N230L/P233G/K249T | + |
| 2507/2508 | S34A/R182G/A307G/E339Q | + |
| 2509/2510 | L78F/F147Y/K158R/R182M/P233R/R271H/A307G/ R345K | + |
| 2511/2512 | F147Y/K158R/R182G/P233G/R271H/A307G/E339Q | + |
| 2513/2514 | S34A/F48L/F147Y/R271H | + |
| 2515/2516 | S34A/M220V/A307G | + |
| 2517/2518 | R182M/M220V/R345K | + |
| 2519/2520 | F48L/L78F/F147Y/K158R/P233G/K249T | + |
| 2521/2522 | F48L/F147Y/P233R | + |
| 2523/2524 | K158R/I315V/E339Q | + |
| 2525/2526 | S34A/L78F/M220V/R271H | + |
| 2527/2528 | S34A/F147Y/M220V/R271H | + |
| 2529/2530 | L78F/E339Q | + |
| 2531/2532 | L78F/K158R/R182M/A307G/I315V/R345K | + |
| 2533/2534 | F48L/K158R/R182M/N230L/P233R/K249T | + |
| 2535/2536 | L78F/F147Y/N230L/A307G | + |
| 2537/2538 | S34A/F147Y | + |
| 2539/2540 | L78F/K158R/R182M/P233R/R271H/I315V | + |
| 2541/2542 | S34A/L78F/F147Y/R182G/P233R/K249T/I315V | + |
| 2543/2544 | S34A/F48L/F147Y | + |
| 2545/2546 | F147Y/K249T | + |
| 2547/2548 | R271H/E339Q | + |
| 2549/2550 | L78F/F147Y/K158R/R182G/N230L/K249T | + |
| 2551/2552 | F48L/L78F/F147Y/R182G/N230L/P233G/K249T | + |
| 2553/2554 | F48L/R182G/A307G/I315V | + |
| 2555/2556 | S34A/F48L/F147Y/R182G/N230L/P233G/K249T/A307G | + |
| 2557/2558 | F147Y/M220V | + |
| 2559/2560 | S34A/L78F/F147Y/R182M/M220V/K249T | + |
| 2561/2562 | L78F/K158R/R182M | + |
| 2563/2564 | S34A/F48L/E339Q | + |
| 2565/2566 | F48L/F147Y/R271H/A307G/E339Q | + |
| 2567/2568 | F147Y/R182M/N230L/A307G/I315V/E339Q | + |
| 2569/2570 | S34A/L78F/K158R | + |
| 2571/2572 | F147Y/R182G/P233R | + |

TABLE 46.2-continued

| SEQ ID NO: (nt/aa) | Amino Acid Differences (Relative to SEQ ID NO: 2164) | FIOP Product Peak Area Relative to SEQ ID NO: 2164 |
|---|---|---|
| 2573/2574 | S34A/F48L/T133S/K158R/R182G/N230L/P233G/R271H/R345K | + |
| 2575/2576 | I315V | + |
| 2577/2578 | K158R/A307G | + |
| 2579/2580 | L78F/F147Y/P233G | + |
| 2581/2582 | S34A/F147Y/R182M/M220V/N230L/E339Q | + |
| 2583/2584 | F147Y/P233R/R345K | + |
| 2585/2586 | L78F/P233R | + |
| 2587/2588 | S34A/L78F/P204T/M220V/E339Q | + |
| 2589/2590 | T133S/M220V/P233G/R271H | + |
| 2591/2592 | S34A/T133S/F147Y/K158R/N230L/P233G/K249T | + |
| 2593/2594 | L78F/T133S/F147Y/K158R/R182G/M220V/R271H/E339Q | + |
| 2595/2596 | S34A/L78F/E84G/K158R/N230L | + |
| 2597/2598 | T133S/A307G | + |
| 2599/2600 | F48L/L78F/K158R/N230L/E339Q | + |
| 2601/2602 | L78F/F147Y/K158R/R182G/E339Q/R345K | + |
| 2603/2604 | S34A/F48L/L78F/K158R/R182G/P233R/I315V/R345K | + |
| 2605/2606 | K249T | + |
| 2607/2608 | S34A/F48L/L78F/R182G/M220V/P233R | + |
| 2609/2610 | F147Y/K158R/M220V/K249T/I315V | + |
| 2611/2612 | F147Y/K158R/P233G/K249T | + |
| 2613/2614 | F48L/R182M | + |
| 2615/2616 | F48L/E339Q | + |
| 2617/2618 | F147Y/E339Q | + |
| 2619/2620 | K158R/I315V | + |
| 2621/2622 | F48L/F147Y/K158R/R182M/M220V/N230L/K249T/R271H/A307G/I315V/E339Q | + |
| 2623/2624 | F48L/F147Y/K158R/A307G/R345K | + |
| 2625/2626 | K158R/P233R | + |
| 2627/2628 | S34A/E339Q | + |
| 2629/2630 | M220V/K249T | + |
| 2631/2632 | R182G/N230L/P233R | + |
| 2633/2634 | S34A/F147Y/N230L/I273N/I315V/R345K | + |
| 2635/2636 | P233G/I315V | + |
| 2637/2638 | S34A/F48L/L78F/T133S/F147Y/R182M | + |
| 2639/2640 | M220V | + |
| 2641/2642 | P233R/R271H | + |
| 2643/2644 | L78F/V135A/R182M/P233R/K249T/I315V/R345K | + |
| 2645/2646 | P233R | + |
| 2647/2648 | S34A/F147Y/E155D/P233G/E339Q | + |
| 2649/2650 | L78F/F147Y/K158R/M220V/N230L/P233G/K249T/R271H/A307G/I315V/R345K | + |
| 2651/2652 | F48L/F147Y/K158R/P233G | + |
| 2653/2654 | F48L/L78F/F147Y/K158R/R182M/M220V/N230L/A307G | + |
| 2655/2656 | F147Y/K158R/M220V/N230L/P233R/K249T/R345K | + |
| 2657/2658 | T133S/V135A/A307G/I315V | + |
| 2659/2660 | F48L/L78F/F147Y/K158M/R182G/N230L/K249T/R271H/I315V | + |
| 2661/2662 | S34A/R182M | + |
| 2663/2664 | S34A/L78F/K158R/K249T | + |

Levels of increased activity were determined relative to the reference polypeptide of SEQ ID NO: 2164 and defined as follows: "+" 1.49 to 3.00, "++" >3.00, "+++" >4.50

Example 47

Improvements Over SEQ ID NO: 2666 in the Extension of Oligonucleotide Acceptor Molecules with Nucleotide Triphosphate Donors HTP Screening for Improved TdT Variants SEQ ID NO: 2666 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 47.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 47.1. The quenched reactions were centrifuged at 4,000 rpm for 10 min at 4° C. to pellet any precipitate. Supernatant was then transferred into new HTP plates for analytical analysis as described in Table 47.1.

TABLE 47.1

| All lysis, purification, reaction, quench, and analytical properties |
|---|
| Lysis and purification conditions: Lysis buffer—20 mM Tris-acetate, pH 8, 0.2 g/L lysozyme from chicken egg white; Lysis buffer volume—400 μL; Lysate pre-treatment—Lysates were preincubated at 54° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide—4 μM TTTTTTTCGG; Nucleotide triphosphate—50 μM 3'PO4-dCTP; Reaction buffer—20 mM MOPS, pH 7.2, 0.002 Unit/μL yeast pyrophosphatase (Thermo Scientific), 50 mM potassium acetate, 250 μM cobalt (II) chloride; Reaction volume—20 μL; Lysate dilution—4x dilution prior to adding to the reaction; Reaction temperature—54° C.; Reaction time—15 minutes |
| Quench conditions: Quench solution and volume—Reactions were quenched by the addition of 24 μL acetonitrile. The solutions were mixed well and then further diluted by the addition of 16 μL of 20 mM aqueous EDTA.; Plate type and seal—96-well BioRad PCR plate with a plastic seal |
| Analytical conditions: Instrument—Agilent UHPLC 1260 prime series, Agilent Ultivo—see Example 4; Reaction product detected—TTTTTTTCGGC-3'PO4 |

Activity relative to SEQ ID NO: 2666 (Activity FIOP) was calculated as the product peak area of the variant compared with the product peak area observed by the reaction with SEQ ID NO: 2666 (where the peak area may be set as the average of replicates or else the highest single sample as appropriate). The results are shown in Table 47.2.

TABLE 47.2

| SEQ ID NO: (nt/aa) | Amino Acid Differences (Relative to SEQ ID NO: 2666) | FIOP Product Peak Area Relative to SEQ ID NO: 2666 |
|---|---|---|
| 2667/2668 | K259R | +++ |
| 2669/2670 | R345C | +++ |
| 2671/2672 | K272M | ++ |
| 2673/2674 | R346W | ++ |
| 2675/2676 | I273E | ++ |
| 2677/2678 | K167A | + |
| 2679/2680 | S162T | + |
| 2681/2682 | K365G | + |

Levels of increased activity were determined relative to the reference polypeptide of SEQ ID NO: 2666 and defined as follows: "+" 0.94 to 1.10, "++" >1.10, "+++" >1.25

Example 48

Improvements Over SEQ ID NO: 2666 in the Extension of Oligonucleotide Acceptor Molecules with Nucleotide Triphosphate Donors HTP Screening for Improved TdT Variants SEQ ID NO: 2666 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 48.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 48.1. The quenched reactions were centrifuged at 4,000 rpm for 10 min at 4° C. to pellet any precipitate. Supernatant was then transferred into new HTP plates for analytical analysis as described in Table 48.1.

TABLE 48.1

| All lysis, purification, reaction, quench, and analytical properties |
|---|
| Lysis and purification conditions: Lysis buffer—20 mM Tris-acetate, pH 8, 0.2 g/L lysozyme from chicken egg white; Lysis buffer volume—400 μL; Lysate pre-treatment—Lysates were preincubated at 54° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide—4 μM TTTTTTTCCG; Nucleotide triphosphate—50 μM 3'PO4-dCTP; Reaction buffer—20 mM MOPS, pH 7.2, 0.002 Unit/μL yeast pyrophosphatase (Thermo Scientific), 50 mM potassium acetate, 250 μM cobalt (II) chloride; Reaction volume—20 μL; Lysate dilution—4x dilution prior to adding to the reaction; Reaction temperature—54° C.; Reaction time—15 minutes |
| Quench conditions: Quench solution and volume—Reactions were quenched by the addition of 24 μL acetonitrile. The solutions were mixed well and then further diluted by the addition of 16 μL of 20 mM aqueous EDTA.; Plate type and seal—96-well BioRad PCR plate with a plastic seal |
| Analytical conditions: Instrument—Agilent UHPLC 1260 prime series, Agilent Ultivo—see Example 4; Reaction product detected—TTTTTTTCCGC-3'PO4 |

Activity relative to SEQ ID NO: 2666 (Activity FIOP) was calculated as the product peak area of the variant compared with the product peak area observed by the reaction with SEQ ID NO: 2666 (where the peak area may be set as the average of replicates or else the highest single sample as appropriate). The results are shown in Table 48.2.

TABLE 48.2

| SEQ ID NO: (nt/aa) | Amino Acid Differences (Relative to SEQ ID NO: 2666) | FIOP Product Peak Area Relative to SEQ ID NO: 2666 |
|---|---|---|
| 2669/2670 | R345C | +++ |
| 2671/2672 | K272M | ++ |
| 2683/2684 | R346Q | ++ |
| 2673/2674 | R346W | ++ |
| 2675/2676 | I273E | + |
| 2685/2686 | E260P | + |
| 2687/2688 | Q280S | + |

Levels of increased activity were determined relative to the reference polypeptide of SEQ ID NO: 2666 and defined as follows: "+" 1.01 to 1.08, "++" >1.08, "+++" >1.20

Example 49

Improvements Over SEQ ID NO: 2666 in the Extension of Oligonucleotide Acceptor Molecules with Nucleotide Triphosphate Donors HTP Screening for Improved TdT Variants SEQ ID NO: 2666 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 49.1.

Reactions were performed in 96-well format 200 µL BioRad PCR plates. Reactions included 1-4 µM oligonucleotide, 25-200 µM nucleotide triphosphate, 0.002 Unit/µL yeast pyrophosphatase (Thermo Scientific), 20 mM buffer, 50 mM potassium acetate, and 250 µM cobalt (II) chloride. The reactions were set up as follows: (i) all reaction components, except for TdT, were pre-mixed in a single solution, and 15 µL of this solution was aliquoted into each well of the 96-well plates (ii) 5 µL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 49.1. The quenched reactions were centrifuged at 4,000 rpm for 10 min at 4° C. to pellet any precipitate. Supernatant was then transferred into new HTP plates for analytical analysis as described in Table 49.1.

TABLE 49.1

| All lysis, purification, reaction, quench, and analytical properties |
|---|
| Lysis and purification conditions: Lysis buffer—20 mM Tris-acetate, pH 8, 0.2 g/L lysozyme from chicken egg white; Lysis buffer volume—400 µL; Lysate pre-treatment—Lysates were preincubated at 54° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide—4 µM TTTTTTTCGA; Nucleotide triphosphate—50 µM 3'PO4-dCTP; Reaction buffer—20 mM MOPS, pH 7.2, 0.002 Unit/µL yeast pyrophosphatase (Thermo Scientific), 50 mM potassium acetate, 250 µM cobalt (II) chloride; Reaction volume—20 µL; Lysate dilution—4x dilution prior to adding to the reaction; Reaction temperature—54° C.; Reaction time—15 minutes |
| Quench conditions: Quench solution and volume—Reactions were quenched by the addition of 24 µL acetonitrile. The solutions were mixed well and then further diluted by the addition of 16 µL of 20 mM aqueous EDTA.; Plate type and seal—96-well BioRad PCR plate with a plastic seal |
| Analytical conditions: Instrument—Agilent UHPLC 1260 prime series, Agilent Ultivo—see Example 4; Reaction product detected—TTTTTTTCGAC-3'PO4 |

Activity relative to SEQ ID NO: 2666 (Activity FIOP) was calculated as the product peak area of the variant compared with the product peak area observed by the reaction with SEQ ID NO: 2666 (where the peak area may be set as the average of replicates or else the highest single sample as appropriate). The results are shown in Table 49.2.

TABLE 49.2

| SEQ ID NO: (nt/aa) | Amino Acid Differences (Relative to SEQ ID NO: 2666) | FIOP Product Peak Area Relative to SEQ ID NO: 2666 |
|---|---|---|
| 2667/2668 | K259R | +++ |
| 2689/2690 | K272G | +++ |
| 2685/2686 | E260P | +++ |
| 2691/2692 | R367G | ++ |
| 2693/2694 | G373M | ++ |
| 2671/2672 | K272M | ++ |
| 2683/2684 | R346Q | ++ |
| 2695/2696 | K170R | + |
| 2697/2698 | E325S | + |
| 2699/2700 | K371P | + |
| 2701/2702 | K167R | + |
| 2703/2704 | I368S | + |
| 2705/2706 | K365S | + |

Levels of increased activity were determined relative to the reference polypeptide of SEQ ID NO: 2666 and defined as follows: "+" 0.91 to 0.95, "++" >0.95, "+++" >1.05

Example 50

Improvements Over SEQ ID NO: 2666 in the Extension of Oligonucleotide Acceptor Molecules with Nucleotide Triphosphate Donors HTP Screening for Improved TdT Variants SEQ ID NO: 2666 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 50.1.

Reactions were performed in 96-well format 200 µL BioRad PCR plates. Reactions included 1-4 µM oligonucleotide, 25-200 µM nucleotide triphosphate, 0.002 Unit/µL yeast pyrophosphatase (Thermo Scientific), 20 mM buffer, 50 mM potassium acetate, and 250 µM cobalt (II) chloride. The reactions were set up as follows: (i) all reaction components, except for TdT, were pre-mixed in a single solution, and 15 µL of this solution was aliquoted into each well of the 96-well plates (ii) 5 µL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 50.1. The quenched reactions were centrifuged at 4,000 rpm for 10 min at 4° C. to pellet any precipitate. Supernatant was then transferred into new HTP plates for analytical analysis as described in Table 50.1.

TABLE 50.1

| All lysis, purification, reaction, quench, and analytical properties |
|---|
| Lysis and purification conditions: Lysis buffer—20 mM Tris-acetate, pH 8, 0.2 g/L lysozyme from chicken egg white; Lysis buffer volume—400 µL; Lysate pre-treatment—Lysates were preincubated at 54° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide—4 µM TTTTTTTCTG; Nucleotide triphosphate—50 µM 3'PO4-dCTP; Reaction buffer—20 mM MOPS, pH 7.2, 0.002 Unit/µL yeast pyrophosphatase (Thermo Scientific), 50 mM potassium acetate, 250 µM cobalt (II) chloride; Reaction volume—20 µL; Lysate dilution—4x dilution prior to adding to the reaction; Reaction temperature—54° C.; Reaction time—15 minutes |
| Quench conditions: Quench solution and volume—Reactions were quenched by the addition of 24 µL acetonitrile. The solutions were mixed well and then further diluted by the addition of 16 µL of 20 mM aqueous EDTA.; Plate type and seal—96-well BioRad PCR plate with a plastic seal |
| Analytical conditions: Instrument—Agilent UHPLC 1260 prime series, Agilent Ultivo—see Example 4; Reaction product detected—TTTTTTTCTGC-3'PO4 |

Activity relative to SEQ ID NO: 2666 (Activity FIOP) was calculated as the product peak area of the variant compared with the product peak area observed by the reaction with SEQ ID NO: 2666 (where the peak area may be set as the average of replicates or else the highest single sample as appropriate). The results are shown in Table 50.2.

TABLE 50.2

| SEQ ID NO: (nt/aa) | Amino Acid Differences (Relative to SEQ ID NO: 2666) | FIOP Product Peak Area Relative to SEQ ID NO: 2666 |
|---|---|---|
| 2667/2668 | K259R | +++ |
| 2669/2670 | R345C | +++ |
| 2671/2672 | K272M | ++ |
| 2673/2674 | R346W | ++ |
| 2675/2676 | I273E | ++ |
| 2691/2692 | R367G | ++ |
| 2689/2690 | K272G | + |
| 2697/2698 | E325S | + |
| 2679/2680 | S162T | + |
| 2693/2694 | G373M | + |
| 2683/2684 | R346Q | + |

Levels of increased activity were determined relative to the reference polypeptide of SEQ ID NO: 2666 and defined as follows: "+" 0.88 to 0.95, "++" >0.95, "+++" >1.12

Example 51

Improvements Over SEQ ID NO: 2666 in the Extension of Oligonucleotide Acceptor Molecules with Nucleotide Triphosphate Donors HTP Screening for Improved TdT Variants SEQ ID NO: 2666 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 51.1.

Reactions were performed in 96-well format 200 µL BioRad PCR plates. Reactions included 1-4 µM oligonucleotide, 25-200 µM nucleotide triphosphate, 0.002 Unit/µL yeast pyrophosphatase (Thermo Scientific), 20 mM buffer, 50 mM potassium acetate, and 250 µM cobalt (II) chloride. The reactions were set up as follows: (i) all reaction components, except for TdT, were pre-mixed in a single solution, and 15 µL of this solution was aliquoted into each well of the 96-well plates (ii) 5 µL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 51.1. The quenched reactions were centrifuged at 4,000 rpm for 10 min at 4° C. to pellet any precipitate. Supernatant was then transferred into new HTP plates for analytical analysis as described in Table 51.1.

TABLE 51.1

| All lysis, purification, reaction, quench, and analytical properties |
|---|
| Lysis and purification conditions: Lysis buffer—20 mM Tris-acetate, pH 8, 0.2 g/L lysozyme from chicken egg white; Lysis buffer volume—400 µL; Lysate pre-treatment—Lysates were preincubated at 56° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide—4 µM TTTTTTTATC; Nucleotide triphosphate—50 µM 3'PO4-dCTP; Reaction buffer—20 mM MOPS, pH 7.2, 0.002 Unit/µL yeast pyrophosphatase (Thermo Scientific), 50 mM potassium acetate, 250 µM cobalt (II) chloride; Reaction volume—36 µL; Lysate |

TABLE 51.1-continued

| All lysis, purification, reaction, quench, and analytical properties |
|---|
| dilution—16x dilution prior to adding to the reaction; Reaction temperature—56° C.; Reaction time—15 minutes |
| Quench conditions: Quench solution and volume—Reactions were quenched by adding two volumes of 90% acetonitrile and 10% methanol mixture and clarifying by centrifugation; Plate type and seal—384-well microtiter plate with a foil seal |
| Analytical conditions: Instrument—Agilent RapidFire SPE-MS/MS—see Example 6; Reaction product detected—TTTTTTTATCC-3'PO4 |

Activity relative to SEQ ID NO: 2666 (Activity FIOP) was calculated as the product peak area of the variant compared with the product peak area observed by the reaction with SEQ ID NO: 2666 (where the peak area may be set as the average of replicates or else the highest single sample as appropriate). The results are shown in Table 51.2.

TABLE 51.2

| SEQ ID NO: (nt/aa) | Amino Acid Differences (Relative to SEQ ID NO: 2666) | FIOP Product Peak Area Relative to SEQ ID NO: 2666 |
|---|---|---|
| 2707/2708 | K366E | +++ |
| 2709/2710 | R346V | +++ |
| 2711/2712 | F324W | +++ |
| 2713/2714 | L268I | +++ |
| 2715/2716 | G373S | +++ |
| 2717/2718 | L268V | +++ |
| 2719/2720 | Y327F | +++ |
| 2721/2722 | I355L | +++ |
| 2723/2724 | R200C/H271G | +++ |
| 2725/2726 | R346I | ++ |
| 2727/2728 | R346A | ++ |
| 2729/2730 | A328S | ++ |
| 2683/2684 | R346Q | ++ |
| 2731/2732 | I321V | ++ |
| 2733/2734 | T262S | ++ |
| 2673/2674 | R346W | ++ |
| 2735/2736 | K164W | ++ |
| 2737/2738 | SI62V | ++ |
| 2739/2740 | N278D | ++ |
| 2677/2678 | K167A | ++ |
| 2741/2742 | K164S | ++ |
| 2671/2672 | K272M | + |
| 2743/2744 | S162T | + |
| 2745/2746 | A284S | + |
| 2747/2748 | K170T | + |
| 2749/2750 | G353H | + |
| 2751/2752 | K366R | + |
| 2753/2754 | R352C | + |
| 2755/2756 | R346S | + |
| 2757/2758 | F136W | + |
| 2759/2760 | K164A | + |
| 2761/2762 | I368V | + |
| 2763/2764 | S162C | + |
| 2765/2766 | Q267E | + |
| 2767/2768 | S162H | + |
| 2705/2706 | K365S | + |
| 2769/2770 | R352V | + |
| 2699/2700 | K371P | + |
| 2681/2682 | K365G | + |
| 2689/2690 | K272G | + |
| 2771/2772 | L364K | + |
| 2693/2694 | G373M | + |
| 2669/2670 | R345C | + |
| 2773/2774 | S162F | + |

TABLE 51.2-continued

| SEQ ID NO: (nt/aa) | Amino Acid Differences (Relative to SEQ ID NO: 2666) | FIOP Product Peak Area Relative to SEQ ID NO: 2666 |
|---|---|---|
| 2775/2776 | S162E | + |
| 2777/2778 | L370Y | + |
| 2779/2780 | K259V | + |

Levels of increased activity were determined relative to the reference polypeptide of SEQ ID NO: 2666 and defined as follows: "+" 1.01 to 1.20, "++" >1.20, "+++" >1.35

Example 52

Improvements Over SEQ ID NO: 2666 in the Extension of Oligonucleotide Acceptor Molecules with Nucleotide Triphosphate Donors HTP Screening for Improved TdT Variants SEQ ID NO: 2666 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 52.1.

Reactions were performed in 96-well format 200 µL BioRad PCR plates. Reactions included 1-4 µM oligonucleotide, 25-200 µM nucleotide triphosphate, 0.002 Unit/µL yeast pyrophosphatase (Thermo Scientific), 20 mM buffer, 50 mM potassium acetate, and 250 µM cobalt (II) chloride. The reactions were set up as follows: (i) all reaction components, except for TdT, were pre-mixed in a single solution, and 15 µL of this solution was aliquoted into each well of the 96-well plates (ii) 5 µL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 52.1. The quenched reactions were centrifuged at 4,000 rpm for 10 min at 4° C. to pellet any precipitate. Supernatant was then transferred into new HTP plates for analytical analysis as described in Table 52.1.

TABLE 52.1

| All lysis, purification, reaction, quench, and analytical properties |
|---|
| Lysis and purification conditions: Lysis buffer—20 mM Tris-acetate, pH 8, 0.2 g/L lysozyme from chicken egg white; Lysis buffer volume—400 µL; Lysate pre-treatment—Lysates were preincubated at 60° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide—4 µM TTTTTTTATC; Nucleotide triphosphate—50 µM 3'PO4-dCTP; Reaction buffer—20 mM MOPS, pH 7.2, 0.002 Unit/µL yeast pyrophosphatase (Thermo Scientific), 50 mM potassium acetate, 250 µM cobalt (II) chloride; Reaction volume—36 µL; Lysate dilution—None; Reaction temperature—60° C.; Reaction time—15 minutes |
| Quench conditions: Quench solution and volume—Reactions were quenched by adding two volumes of 90% acetonitrile and 10% methanol mixture and clarifying by centrifugation; Plate type and seal—384-well microtiter plate with a foil seal |
| Analytical conditions: Instrument—Agilent RapidFire SPE-MS/MS—see Example 6; Reaction product detected—TTTTTTTATCC-3'PO4 |

Activity relative to SEQ ID NO: 2666 (Activity FIOP) was calculated as the product peak area of the variant compared with the product peak area observed by the reaction with SEQ ID NO: 2666 (where the peak area may be set as the average of replicates or else the highest single sample as appropriate). The results are shown in Table 52.2.

TABLE 52.2

| SEQ ID NO: (nt/aa) | Amino Acid Differences (Relative to SEQ ID NO: 2666) | FIOP Product Peak Area Relative to SEQ ID NO: 2666 |
|---|---|---|
| 2781/2782 | G20R/Q100D/L203V | +++ |
| 2783/2784 | G20R/Q100D/V104L/V1201/N197E/R367K | +++ |
| 2785/2786 | G20K/V120I/E235M | +++ |
| 2787/2788 | G20E/Q100D/V1201/N 197E/G232M/E235M/I315 V/ K366S/R367K | +++ |
| 2789/2790 | G20K/Q100D/V104L/L203V/E350L/G353D | ++ |
| 2791/2792 | G20R/Q100D/V104L/E111R/K242R | ++ |
| 2793/2794 | G20K/V1201/N 197E/G292K | ++ |
| 2795/2796 | G20K/Q100D/G232M/G292K/K366S/R367K | ++ |
| 2797/2798 | Q100D/E111R | + |
| 2799/2800 | Q100D/V1201/N 197E/K242R | + |
| 2801/2802 | G20R/V104L/E 111R/V1 20I/L203V | + |
| 2803/2804 | G20K/G292K | + |
| 2805/2806 | G20R/Q100D/V104L/N197E/L203V/K242R/G292K | + |
| 2807/2808 | G20R/Q100D/N197E/G292K/I315 V | + |
| 2809/2810 | E111R/N197E/K242R | + |
| 2811/2812 | G20K/Q100D/E111R | + |
| 2813/2814 | G20K/Q100D | + |
| 2815/2816 | V104L/V120I/G232M/G353D | + |
| 2817/2818 | G20K | + |
| 2819/2820 | G20R/Q100D/E235M/I315V/R367K | + |
| 2821/2822 | Q100D | + |

Levels of increased activity were determined relative to the reference polypeptide of SEQ ID NO: 2666 and defined as follows: "+" 1.29 to 1.70, "++" > 1.70, "+++" > 1.80

Example 53

Improvements Over SEQ ID NO: 2794 in the Extension of Oligonucleotide Acceptor Molecules with Nucleotide Triphosphate Donors HTP Screening for Improved TdT Variants SEQ ID NO: 2794 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 53.1.

Reactions were performed in 96-well format 200 µL BioRad PCR plates. Reactions included 1-4 µM oligonucleotide, 25-200 µM nucleotide triphosphate, 0.002 Unit/µL yeast pyrophosphatase (Thermo Scientific), 20 mM buffer, 50 mM potassium acetate, and 250 µM cobalt (II) chloride. The reactions were set up as follows: (i) all reaction components, except for TdT, were pre-mixed in a single solution, and 15 µL of this solution was aliquoted into each well of the 96-well plates (ii) 5 µL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 53.1. The quenched reactions were centrifuged at 4,000 rpm for 10 min at 4° C. to pellet any precipitate. Supernatant was then transferred into new HTP plates for analytical analysis as described in Table 53.1.

TABLE 53.1

| All lysis, purification, reaction, quench, and analytical properties |
|---|
| Lysis and purification conditions : Lysis buffer - 20mM Tris-acetate, pH 8, 0.2 g/L lysozyme from chicken egg white; Lysis buffer volume - 400 μL; Lysate pre-treatment - Lysates were preincubated at 60° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide - 4 μM TTTTTTTCTG; Nucleotide triphosphate - 50 μM 3'PO4-dCTP; Reaction buffer - 20 mM MOPS, pH 7.2, 0.002 Unit/pL yeast pyrophosphatase (Thermo Scientific), 50 mM potassium acetate, 250 μM cobalt (II) chloride; Reaction volume - 20 μL ; Lysate dilution - 4× dilution prior to adding to the reaction; Reaction temperature - 60° C.; Reaction time - 15 minutes |
| Quench conditions: Quench solution and volume - Reactions were quenched by the addition of 24 pL acetonitrile. The solutions were mixed well and then further diluted by the addition of 16 μL of 20 mM aqueous EDTA. ; Plate type and seal - 96-well BioRad PCR plate with a plastic seal |
| Analytical conditions: Instrument - Agilent UHPLC 1260 prime series, Agilent Ultivo - see Example 4; Reaction product detected - TTTTTTTCTGC-3'PO4 |

Activity relative to SEQ ID NO: 2794 (Activity FIOP) was calculated as the product peak area of the variant compared with the product peak area observed by the reaction with SEQ ID NO: 2794 (where the peak area may be set as the average of replicates or else the highest single sample as appropriate). The results are shown in Table 53.2.

TABLE 53.2

| SEQ ID NO: (nt/aa) | Amino Acid Differences (Relative to SEQ ID NO: 2794) | FIOP Product Peak Area Relative to SEQ ID NO: 2794 |
|---|---|---|
| 2823/2824 | R342V | +++ |
| 2825/2826 | R342L | +++ |
| 2827/2828 | K366E | +++ |
| 2829/2830 | G373A | +++ |
| 2831/2832 | T201R | +++ |
| 2833/2834 | I355L | +++ |
| 2835/2836 | L203A | +++ |
| 2837/2838 | G373T | +++ |
| 2839/2840 | A360G | +++ |
| 2841/2842 | E377D | ++ |
| 2843/2844 | K234H | ++ |
| 2845/2846 | K366Q | ++ |
| 2847/2848 | 1378V | ++ |
| 2849/2850 | E235T | ++ |
| 2851/2852 | L344M | ++ |
| 2853/2854 | W390Y | ++ |
| 2855/2856 | E238R | ++ |
| 2857/2858 | F226L | ++ |
| 2859/2860 | D237E | ++ |
| 2861/2862 | R352V | ++ |
| 2863/2864 | K234R | ++ |
| 2865/2866 | Q326S | ++ |
| 2867/2868 | R200M | + |
| 2869/2870 | F324A | + |
| 2871/2872 | D237C | + |
| 2873/2874 | R200A | + |
| 2875/2876 | F369L | + |
| 2877/2878 | G373S | + |
| 2879/2880 | K371A | + |
| 2881/2882 | F324T | + |
| 2883/2884 | D237T | + |
| 2885/2886 | E388L | + |
| 2887/2888 | F369Y | + |
| 2889/2890 | N230T | + |
| 2891/2892 | F226M | + |
| 2893/2894 | F202V | + |
| 2895/2896 | D236L | + |
| 2897/2898 | E388A | + |
| 2899/2900 | S374N | + |
| 2901/2902 | R352L | + |
| 2903/2904 | T229S | + |
| 2905/2906 | G383N | + |
| 2907/2908 | K366R | + |

Levels of increased activity were determined relative to the reference polypeptide of SEQ ID NO: 2794 and defined as follows: "+" 1.12 to 1.35, "++" > 1.35, "+++" > 1.60

Example 54

Improvements Over SEQ ID NO: 2794 in the Extension of Oligonucleotide Acceptor Molecules with Nucleotide Triphosphate Donors HTP Screening for Improved TdT Variants SEQ ID NO: 2794 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 54.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 54.1. The quenched reactions were centrifuged at 4,000 rpm for 10 min at 4° C. to pellet any precipitate. Supernatant was then transferred into new HTP plates for analytical analysis as described in Table 54.1.

TABLE 54.1

| All lysis, purification, reaction, quench, and analytical properties |
|---|
| Lysis and purification conditions : Lysis buffer - 20 mM Tris-acetate, pH 8, 0.2 g/L lysozyme from chicken egg white; Lysis buffer volume - 400 μL; Lysate pre-treatment - Lysates were preincubated at 60° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide - 4 μM TTTTTTTCGA; Nucleotide triphosphate - 50 μM 3'PO4-dCTP; Reaction buffer - 20 mM MOPS, pH 7.2, 0.002 Unit/pL yeast pyrophosphatase (Thermo Scientific), 50 mM potassium acetate, 250 μM cobalt (II) chloride; Reaction volume - 20 μL ; Lysate dilution - 4x dilution prior to adding to the reaction; Reaction temperature - 60° C.; Reaction time - 15 minutes |
| Quench conditions: Quench solution and volume - Reactions were quenched by the addition of 24 μL acetonitrile. The solutions were mixed well and then further diluted by the addition of 16 μL of 20 mM aqueous EDTA. ; Plate type and seal - 96-well BioRad PCR plate with a plastic seal |
| Analytical conditions: Instrument - Agilent UHPLC 1260 prime series, Agilent Ultivo - see Example 4; Reaction product detected - TTTTTTTCGAC-3'PO4 |

Activity relative to SEQ ID NO: 2794 (Activity FIOP) was calculated as the product peak area of the variant compared with the product peak area observed by the reaction with SEQ ID NO: 2794 (where the peak area may be set as the average of replicates or else the highest single sample as appropriate). The results are shown in Table 54.2.

TABLE 54.2

| SEQ ID NO: (nt/aa) | Amino Acid Differences (Relative to SEQ ID NO: 2794) | FIOP Product Peak Area Relative to SEQ ID NO: 2794 |
|---|---|---|
| 2909/2910 | A360R | +++ |
| 2823/2824 | R342V | +++ |
| 2887/2888 | F369Y | +++ |
| 2841/2842 | E377D | +++ |
| 2847/2848 | 1378V | +++ |
| 2911/2912 | D237R | ++ |
| 2857/2858 | F226L | ++ |
| 2913/2914 | R200G | ++ |
| 2827/2828 | K366E | ++ |
| 2867/2868 | R200M | ++ |
| 2853/2854 | W390Y | ++ |
| 2825/2826 | R342L | ++ |
| 2859/2860 | D237E | + |
| 2915/2916 | A380M | + |
| 2873/2874 | R200A | + |
| 2863/2864 | K234R | + |
| 2829/2830 | G373A | + |
| 2917/2918 | E350I | + |
| 2871/2872 | D237C | + |
| 2845/2846 | K366Q | + |
| 2835/2836 | L203A | + |

Levels of increased activity were determined relative to the reference polypeptide of SEQ ID NO: 2794 and defined as follows: "+" 1.11 to 1.20, "++" > 1.20, "+++" > 1.40

Example 55

Improvements Over SEQ ID NO: 2794 in the Extension of Oligonucleotide Acceptor Molecules with Nucleotide Triphosphate Donors HTP Screening for Improved TdT Variants SEQ ID NO: 2794 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 55.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 55.1. The quenched reactions were centrifuged at 4,000 rpm for 10 min at 4° C. to pellet any precipitate. Supernatant was then transferred into new HTP plates for analytical analysis as described in Table 55.1.

TABLE 55.1

| All lysis, purification, reaction, quench, and analytical properties |
|---|
| Lysis and purification conditions : Lysis buffer - 20 mM Tris-acetate, pH 8, 0.2 g/L lysozyme from chicken egg white; Lysis buffer volume - 400 μL; Lysate pre-treatment - Lysates were preincubated at 60° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide - 4 μM TTTTTTTCCG; Nucleotide triphosphate - 50 μM 3'PO4-dCTP; Reaction buffer - 20 mM MOPS, pH 7.2, 0.002 Unit/pL yeast pyrophosphatase (Thermo Scientific), 50 mM potassium acetate, 250 μM cobalt (II) chloride; Reaction volume - 20 μL ; Lysate dilution - 4× dilution prior to adding to the reaction; Reaction temperature - 60° C.; Reaction time - 15 minutes |
| Quench conditions: Quench solution and volume - Reactions were quenched by the addition of 24 μL acetonitrile. The solutions were mixed well and then further diluted by the addition of 16 μL of 20 mM aqueous EDTA. ; Plate type and seal - 96-well BioRad PCR plate with a plastic seal |

TABLE 55.1-continued

| All lysis, purification, reaction, quench, and analytical properties |
|---|
| Analytical conditions: Instrument - Agilent UHPLC 1260 prime series, Agilent Ultivo - see Example 4; Reaction product detected - TTTTTTTCCGC-3'PO4 |

Activity relative to SEQ ID NO: 2794 (Activity FIOP) was calculated as the product peak area of the variant compared with the product peak area observed by the reaction with SEQ ID NO: 2794 (where the peak area may be set as the average of replicates or else the highest single sample as appropriate). The results are shown in Table 55.2.

TABLE 55.2

| SEQ ID NO: (nt/aa) | Amino Acid Differences (Relative to SEQ ID NO: 2794) | FIOP Product Peak Area Relative to SEQ ID NO: 2794 |
|---|---|---|
| 2823/2824 | R342V | +++ |
| 2825/2826 | R342L | +++ |
| 2833/2834 | I355L | +++ |
| 2919/2920 | L344T | +++ |
| 2849/2850 | E235T | +++ |
| 2921/2922 | T322C | +++ |
| 2827/2828 | K366E | +++ |
| 2877/2878 | G373S | ++ |
| 2851/2852 | L344M | ++ |
| 2847/2848 | 1378V | ++ |
| 2923/2924 | R233S | ++ |
| 2845/2846 | K366Q | ++ |
| 2835/2836 | L203A | ++ |
| 2843/2844 | K234H | ++ |
| 2829/2830 | G373A | ++ |
| 2925/2926 | V387L | ++ |
| 2927/2928 | L207E | ++ |
| 2863/2864 | K234R | + |
| 2839/2840 | A360G | + |
| 2879/2880 | K371A | + |
| 2831/2832 | T201R | + |
| 2929/2930 | N230Y | + |
| 2867/2868 | R200M | + |
| 2857/2858 | F226L | + |
| 2931/2932 | S374D | + |
| 2933/2934 | K371S | + |
| 2935/2936 | L207A | + |
| 2861/2862 | R352V | + |
| 2873/2874 | R200A | + |
| 2937/2938 | T322P | + |
| 2901/2902 | R352L | + |
| 2913/2914 | R200G | + |

Levels of increased activity were determined relative to the reference polypeptide of SEQ ID NO: 2794 and defined as follows: "+" 1.11 to 1.25, "++" > 1.25, "+++" > 1.50

Example 56

Improvements Over SEQ ID NO: 2794 in the Extension of Oligonucleotide Acceptor Molecules with Nucleotide Triphosphate Donors HTP Screening for Improved TdT Variants SEQ ID NO: 2794 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 56.1.

Reactions were performed in 96-well format 200 µL BioRad PCR plates. Reactions included 1-4 µM oligonucleotide, 25-200 µM nucleotide triphosphate, 0.002 Unit/µL yeast pyrophosphatase (Thermo Scientific), 20 mM buffer, 50 mM potassium acetate, and 250 µM cobalt (II) chloride. The reactions were set up as follows: (i) all reaction components, except for TdT, were pre-mixed in a single solution, and 15 µL of this solution was aliquoted into each well of the 96-well plates (ii) 5 µL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 56.1. The quenched reactions were centrifuged at 4,000 rpm for 10 min at 4° C. to pellet any precipitate. Supernatant was then transferred into new HTP plates for analytical analysis as described in Table 56.1.

TABLE 56.1

| All lysis, purification, reaction, quench, and analytical properties |
|---|
| Lysis and purification conditions : Lysis buffer - 20mM Tris-acetate, pH 8, 0.2 g/L lysozyme from chicken egg white; Lysis buffer volume - 400 µL; Lysate pre-treatment - Lysates were preincubated at 56° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide - 4 µM TTTTTTTATC; Nucleotide triphosphate - 50 µM 3'PO4-dTTP; Reaction buffer - 20 mM MOPS, pH 7.2, 0.002 Unit/pL yeast pyrophosphatase (Thermo Scientific), 50 mM potassium acetate, 250 µM cobalt (II) chloride; Reaction volume - 36 µL ; Lysate dilution - 16× dilution prior to adding to the reaction; Reaction temperature - 56° C.; Reaction time - 15 minutes |
| Quench conditions: Quench solution and volume - Reactions were quenched by adding two volumes of 90% acetonitrile and 10% methanol mixture and clarifying by centrifugation; Plate type and seal - 384-well microtiter plate with a foil seal |
| Analytical conditions: Instrument - Agilent RapidFire SPE-MS/MS - see Example 6; Reaction product detected - TTTTTTTATCT-3'PO4 |

Activity relative to SEQ ID NO: 2794 (Activity FIOP) was calculated as the product peak area of the variant compared with the product peak area observed by the reaction with SEQ ID NO: 2794 (where the peak area may be set as the average of replicates or else the highest single sample as appropriate). The results are shown in Table 56.2.

TABLE 56

| SEQ ID NO: (nt/aa) | Amino Acid Differences (Relative to SEQ ID NO: 2794) | FIOP Product Peak Area Relative to SEQ ID NO: 2794 |
|---|---|---|
| 2857/2858 | F226L | +++ |
| 2919/2920 | L344T | +++ |
| 2923/2924 | R233S | +++ |
| 2887/2888 | F369Y | +++ |
| 2939/2940 | I321C | +++ |
| 2847/2848 | 1378V | +++ |
| 2915/2916 | A380M | +++ |
| 2941/2942 | G353D | +++ |
| 2891/2892 | F226M | +++ |
| 2935/2936 | L207A | +++ |
| 2943/2944 | R200T | ++ |
| 2909/2910 | A360R | ++ |
| 2945/2946 | L207G | ++ |
| 2925/2926 | V387L | ++ |
| 2843/2844 | K234H | ++ |
| 2863/2864 | K234R | ++ |
| 2899/2900 | S374N | ++ |
| 2947/2948 | A330G | ++ |
| 2931/2932 | S374D | ++ |
| 2949/2950 | R200W | ++ |
| 2893/2894 | F202V | ++ |
| 2827/2828 | K366E | ++ |
| 2951/2952 | G353A | ++ |
| 2873/2874 | R200A | ++ |
| 2953/2954 | E388Q | ++ |
| 2859/2860 | D237E | ++ |
| 2955/2956 | E349M | ++ |
| 2851/2852 | L344M | ++ |
| 2957/2958 | D205G | ++ |
| 2959/2960 | P231G | + |
| 2961/2962 | Y386F | + |
| 2963/2964 | G353N | + |
| 2871/2872 | D237C | + |
| 2903/2904 | T229S | + |
| 2889/2890 | N230T | + |
| 2879/2880 | K371A | + |
| 2965/2966 | N230G | + |
| 2913/2914 | R200G | + |
| 2885/2886 | E388L | + |
| 2927/2928 | L207E | + |
| 2967/2968 | A206G | + |
| 2829/2830 | G373A | + |
| 2969/2970 | S15G | + |
| 2881/2882 | F324T | + |

TABLE 56-continued

| SEQ ID NO: (nt/aa) | Amino Acid Differences (Relative to SEQ ID NO: 2794) | FIOP Product Peak Area Relative to SEQ ID NO: 2794 |
|---|---|---|
| 2971/2972 | Y327R | + |
| 2835/2836 | L203A | + |
| 2973/2974 | K234S | + |
| 2853/2854 | W390Y | + |
| 2825/2826 | R342L | + |
| 2883/2884 | D237T | + |
| 2901/2902 | R352L | + |
| 2837/2838 | G373T | + |
| 2975/2976 | E349T | + |
| 2865/2866 | Q326S | + |
| 2867/2868 | R200M | + |

Levels of increased activity were determined relative to the reference polypeptide of SEQ ID NO: 2794 and defined as follows: "+" 1.00 to 1.15, "++" > 1.15, "+++" > 1.35

Example 57

Improvements Over SEQ ID NO: 2794 in the Extension of Oligonucleotide Acceptor Molecules with Nucleotide Triphosphate Donors HTP Screening for Improved TdT Variants SEQ ID NO: 2794 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 57.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 57.1. The quenched reactions were centrifuged at 4,000 rpm for 10 min at 4° C. to pellet any precipitate. Supernatant was then transferred into new HTP plates for analytical analysis as described in Table 57.1.

TABLE 57.1

| All lysis, purification, reaction, quench, and analytical properties |
|---|
| Lysis and purification conditions : Lysis buffer - 20mM Tris-acetate, pH 8, 0.2 g/L lysozyme from chicken egg white; Lysis buffer volume - 400 μL; Lysate pre-treatment - Lysates were preincubated at 56° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide - 4 μM TTTTTTTATG; Nucleotide triphosphate - 50 μM 3'PO4-dATP; Reaction buffer - 20 mM MOPS, pH 7.2, 0.002 Unit/pL yeast pyrophosphatase (Thermo Scientific), 50 mM potassium acetate, 250 pM cobalt (II) chloride; Reaction volume - 36 μL ; Lysate dilution - 4× dilution prior to adding to the reaction; Reaction temperature - 56° C.; Reaction time - 15 minutes |
| Quench conditions: Quench solution and volume - Reactions were quenched by adding two volumes of 90% acetonitrile and 10% methanol mixture and clarifying by centrifugation; Plate type and seal - 384-well microtiter plate with a foil seal |
| Analytical conditions: Instrument - Agilent RapidFire SPE-MS/MS - see Example 6; Reaction product detected - TTTTTTTATGA-3'PO4 |

Activity relative to SEQ ID NO: 2794 (Activity FIOP) was calculated as the product peak area of the variant compared with the product peak area observed by the reaction with SEQ ID NO: 2794 (where the peak area may be set as the average of replicates or else the highest single sample as appropriate). The results are shown in Table 57.2.

TABLE 57.2

| SEQ ID NO: (nt/aa) | Amino Acid Differences (Relative to SEQ ID NO: 2794) | FIOP Product Peak Area Relative to SEQ ID NO: 2794 |
|---|---|---|
| 2977/2978 | Y80S/A143S/L203V/T211A/K338G | +++ |
| 2979/2980 | L268V/I315V/R346V/K366E | +++ |
| 2981/2982 | L268V/F324W/Y327F/R346I | +++ |
| 2983/2984 | L268V/R346I | +++ |
| 2985/2986 | M55L/L268V/I315V/R346V | +++ |
| 2987/2988 | L268V/I315V/R346I | +++ |
| 2989/2990 | I66Q/L69H/A143S/E235M/K338G | +++ |
| 2991/2992 | K62E/L69H/Y80S/V 101C/ V104L/A143S/E235M/K338G | ++ |
| 2993/2994 | L268I/I315V/R346V | ++ |
| 2995/2996 | Y80S/L268I/I315V/R346I/I355L | ++ |
| 2997/2998 | K62E/L203V/T211A/E235M/K338G/E350L | ++ |
| 2999/3000 | M55L/Y80S/L268V/R346V | ++ |
| 3001/3002 | L268V/R346A/I355L | ++ |
| 3003/3004 | L268V/I355L/K366E | ++ |
| 3005/3006 | L268V/Y327F/R346A | ++ |
| 3007/3008 | Y80S/L268V/Y327F/R346I/K366E | ++ |
| 3009/3010 | L268V/I315V/Y327F/R346V | ++ |
| 3011/3012 | L268V/I315V/R346A | ++ |
| 3013/3014 | Y80S/E111R/L268I/F324W/ Y327F/R346I/K366E/G373S | ++ |
| 3015/3016 | M55L/E111R/E156A/L268V/ I315V/F324W/Y327F/K366E/G373S | ++ |
| 3017/3018 | L268I/F324W/Y327F/R346V | ++ |
| 3019/3020 | M55L/Y80S/L174Q/L268I/I355L/K366E | ++ |
| 3021/3022 | Q100D/V101C/T211A/ N278H/K338G/E350L/G353D | ++ |
| 3023/3024 | Y80S/L268V/R346I | + |
| 3025/3026 | Y80S/R346A/K366E | + |
| 3027/3028 | Y327F/R346A | + |
| 3029/3030 | L69H/Y80S/L203V/T211A/N278H/K338G | + |
| 3031/3032 | L268V/R346V | + |
| 3033/3034 | I315V/F324W/Y327F/I355L/K366E | + |
| 3035/3036 | F324W/R346I/I355L/K366E | + |
| 3037/3038 | L268I/I315V/I355L | + |
| 3039/3040 | Y80S/I315V/R346A/L364P/G373S | + |
| 3041/3042 | L268I | + |
| 3043/3044 | M55L/L268V/F324W/K366E | + |
| 3045/3046 | Y80S/L268V/R346V | + |
| 3047/3048 | M55L/E111R/L268V/R346I/I355L | + |
| 3049/3050 | E111R/L268I | + |
| 3051/3052 | K62E/I66Q/L69H/A143S/K338G/G353D | + |

TABLE 57.2-continued

| SEQ ID NO: (nt/aa) | Amino Acid Differences (Relative to SEQ ID NO: 2794) | FIOP Product Peak Area Relative to SEQ ID NO: 2794 |
|---|---|---|
| 3053/3054 | Y80S/E111R/I355L/K366E | + |
| 3055/3056 | M55L/E111R/L268V/I355L/K366E | + |
| 3057/3058 | M55L/L268V | + |
| 3059/3060 | M55L/L268I/R346V/I355L | + |
| 3061/3062 | L268I/F324W | + |
| 3063/3064 | K62E/I66Q/Q100D/V101C/ V104L/L203V/E235M/K338G | + |
| 3065/3066 | M55L/Y80S/L268I/I315V/K366E | + |
| 3067/3068 | M55L/E111R/I315V/I355L/G373S | + |

Levels of increased activity were determined relative to the reference polypeptide of SEQ ID NO: 2794 and defined as follows: "+" 1.31 to 1.50, "++" > 1.50, "+++" > 1.75

Example 58

Improvements Over SEQ ID NO: 2978 in the Extension of Oligonucleotide Acceptor Molecules with Nucleotide Triphosphate Donors HTP Screening for Improved TdT Variants SEQ ID NO: 2978 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 58.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 58.1. The quenched reactions were centrifuged at 4,000 rpm for 10 min at 4° C. to pellet any precipitate. Supernatant was then transferred into new HTP plates for analytical analysis as described in Table 58.1.

TABLE 58.1

| All lysis, purification, reaction, quench, and analytical properties |
|---|
| Lysis and purification conditions : Lysis buffer - 20mM Tris-acetate, pH 8, 0.2 g/L lysozyme from chicken egg white; Lysis buffer volume - 400 μL; Lysate pre-treatment - Lysates were preincubated at 62° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide - 4 μM TTTTTTTATC; Nucleotide triphosphate - 50 μM 3'PO4-dGTP; Reaction buffer - 20 mM MOPS, pH 7.2, 0.002 Unit/pL yeast pyrophosphatase (Thermo Scientific), 50 mM potassium acetate, 250 μM cobalt (II) chloride; Reaction volume - 36 μL ; Lysate dilution - None; Reaction temperature - 62° C.; Reaction time - 15 minutes |
| Quench conditions: Quench solution and volume - Reactions were quenched by adding two volumes of 90% acetonitrile and 10% methanol mixture and clarifying by centrifugation; Plate type and seal - 384-well microtiter plate with a foil seal |
| Analytical conditions: Instrument - Agilent RapidFire SPE-MS/MS - see Example 6; Reaction product detected - TTTTTTTATCG-3'PO4 |

Activity relative to SEQ ID NO: 2978 (Activity FIOP) was calculated as the product peak area of the variant compared with the product peak area observed by the reaction with SEQ ID NO: 2978 (where the peak area may be set as the average of replicates or else the highest single sample as appropriate). The results are shown in Table 58.2.

TABLE 58.2

| SEQ ID NO: (nt/aa) | Amino Acid Differences (Relative to SEQ ID NO: 2978) | FIOP Product Peak Area Relative to SEQ ID NO: 2978 |
|---|---|---|
| 3069/3070 | K62E/E111R/E235M/I315V/I355L | +++ |
| 3071/3072 | L69H/Q100D/E111R/V298I/G353D/I355L | +++ |
| 3073/3074 | I66Q/Q100D/E235M/I315V/Y327F/G353D/I355L | +++ |
| 3075/3076 | K62E/E111R/E235M/F324W/R346I | +++ |
| 3077/3078 | L69H/E111R/E235M/T300K/G353D/I355L | +++ |
| 3079/3080 | Q100D/L268V/R346I | +++ |
| 3081/3082 | Ell 1R/E235M/L268V/R346I | +++ |
| 3083/3084 | I66Q/E235M/L268V/R346I | +++ |
| 3085/3086 | Q100D/E235M/R346I/E350L/G353D | +++ |
| 3087/3088 | I66Q/E111R/R346V/G353D/I355L | +++ |
| 3089/3090 | Q100D/E111R/G353D | +++ |
| 3091/3092 | Q100D/E235M/L268V/I315V/R346I | +++ |
| 3093/3094 | L69H/G353D/I355L | ++ |
| 3095/3096 | K62E/L69H/Q100D/E235M/L268V/R346I | ++ |
| 3097/3098 | Ell 1R/E235M/L268V/Y327F/R346V | ++ |
| 3099/3100 | L69H/E111R/E235M/I315V | ++ |
| 3101/3102 | L69H/L268V/R346V/G353D | ++ |
| 3103/3104 | L69H/E111R/E235M | ++ |
| 3105/3106 | L69H/L268V/R346I | ++ |
| 3107/3108 | L69H/Q100D | ++ |
| 3109/3110 | G353D/I355L | ++ |
| 3111/3112 | E235M/I315V/G353D/I355L | ++ |
| 3113/3114 | E235M/L268V/R346I | ++ |
| 3115/3116 | L268V/R346I | ++ |
| 3117/3118 | K62E/E235M/L268V/Y327F/ R346I/E350L/G353D/I355L | ++ |
| 3119/3120 | E111R/L268V | ++ |
| 3121/3122 | K62E/L69H/G353D | ++ |
| 3123/3124 | I66Q/E235M/R346S | ++ |
| 3125/3126 | L268V/R346I/E350L/G353D/I355L | ++ |
| 3127/3128 | E235M/G353D/355L | ++ |
| 3129/3130 | Ell 1R/E235M/R346V/E350L | ++ |
| 3131/3132 | I66Q/E235M/G373S | ++ |
| 3133/3134 | Q100D/L268V/K366E | + |
| 3135/3136 | L69H/I315V/G353D | + |
| 3137/3138 | E235M/G353D | + |
| 3139/3140 | F324W/I355L | + |
| 3141/3142 | I315V/Y327F/R346I | + |
| 3143/3144 | E235M/R346V/E350L | + |
| 3145/3146 | L69H/F324W/Y327F/R346I | + |
| 3147/3148 | L268V/G353D | + |
| 3149/3150 | K62E/P323S/R346I/G353D/I355L | + |
| 3151/3152 | L69H/Q100D/G353D/K366E | + |
| 3153/3154 | K62E/E235M/R346V/E350L/I355L | + |
| 3155/3156 | F324W/Y327F/R346I | + |
| 3157/3158 | E235M/L268V/Y327F/R346V | + |
| 3159/3160 | L69H/F324W/G353D | + |
| 3161/3162 | L69H/F324W/R346I/E350L | + |
| 3163/3164 | L69H/E235M/I315V | + |
| 3165/3166 | E235M/R346I | + |
| 3167/3168 | R346I | + |
| 3169/3170 | E111R/Y327F | + |
| 3171/3172 | Q100D | + |
| 3173/3174 | E235M/R346V | + |
| 3175/3176 | Y327F/R346V | + |
| 3177/3178 | I66Q | + |
| 3179/3180 | L69H | + |
| 3181/3182 | E235M/I315V | + |
| 3183/3184 | Q100D/E235M/L268V/K366E/G373S | + |
| 3185/3186 | L69H/E235M/G353D | + |
| 3187/3188 | Q100D/E235M/L268V/R346V/I355L | + |
| 3189/3190 | L69H/Q100D/E235M | + |
| 3191/3192 | L69H/L268V | + |
| 3193/3194 | K62E/I315V/Y327F/G353D | + |
| 3195/3196 | G232D/R346I/E350L/I355L | + |
| 3197/3198 | L69H/L268V/F324W/Y327F/G353D/I355L | + |
| 3199/3200 | F324W/R346I/E350L | + |

Levels of increased activity were determined relative to the reference polypeptide of SEQ ID NO: 2978 and defined as follows: "+" 1.18 to 1.50, "++" > 1.50, "+++" > 3.25

Example 59

Improvements Over SEQ ID NO: 3074 in the Extension of Oligonucleotide Acceptor Molecules with Nucleotide Triphosphate Donors HTP Screening for Improved TdT Variants SEQ ID NO: 3074 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 59.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 59.1. The quenched reactions were centrifuged at 4,000 rpm for 10 min at 4° C. to pellet any precipitate. Supernatant was then transferred into new HTP plates for analytical analysis as described in Table 59.1.

TABLE 59.1

| All lysis, purification, reaction, quench, and analytical properties |
|---|
| Lysis and purification conditions : Lysis buffer - 20mM Tris-acetate, pH 8, 0.2 g/L lysozyme from chicken egg white; Lysis buffer volume - 400 uL; Lysate pre-treatment - Lysates were preincubated at 60 °C for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide - 4 μM TTTTTTTCGG; Nucleotide triphosphate - 50 μM 3'PO4-dGTP; Reaction buffer - 20 mM MOPS, pH 7.2, 0.002 Unit/pL yeast pyrophosphatase (Thermo Scientific), 50 mM potassium acetate, 250 μM cobalt (II) chloride; Reaction volume - 36 μL ; Lysate dilution - 4× dilution prior to adding to the reaction; Reaction temperature - 60° C.; Reaction time - 15 minutes |
| Quench conditions: Quench solution and volume - Reactions were quenched by adding two volumes of 90% acetonitrile and 10% methanol mixture and clarifying by centrifugation; Plate type and seal - 384-well microtiter plate with a foil seal |
| Analytical conditions: Instrument - Agilent RapidFire SPE-MS/MS - see Example 6; Reaction product detected - TTTTTTTCGGG-3'PO4 |

Activity relative to SEQ ID NO: 3074 (Activity FIOP) was calculated as the product peak area of the variant compared with the product peak area observed by the reaction with SEQ ID NO: 3074 (where the peak area may be set as the average of replicates or else the highest single sample as appropriate). The results are shown in Table 59.2.

TABLE 59.2

| SEQ ID NO: (nt/aa) | Amino Acid Differences (Relative to SEQ ID NO: 3074) | FIOP Product Peak Area Relative to SEQ ID NO: 3074 |
|---|---|---|
| 3201/3202 | G373N | +++ |
| 3203/3204 | N16M | ++ |
| 3205/3206 | K234A | ++ |
| 3207/3208 | K234Q | + |
| 3209/3210 | A380S | + |
| 3211/3212 | T17R | + |
| 3213/3214 | I210L | + |

Levels of increased activity were determined relative to the reference polypeptide of SEQ ID NO: 3074 and defined as follows: "+" 1.04 to 1.20, "++" > 1.20, "+++" > 1.30

Example 60

Improvements Over SEQ ID NO: 3074 in the Extension of Oligonucleotide Acceptor Molecules with Nucleotide Triphosphate Donors HTP Screening for Improved TdT Variants SEQ ID NO: 3074 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 60.1.

Reactions were performed in 96-well format 200 μL BioRad PCR plates. Reactions included 1-4 μM oligonucleotide, 25-200 mM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 60.1. The quenched reactions were centrifuged at 4,000 rpm for 10 min at 4° C. to pellet any precipitate. Supernatant was then transferred into new HTP plates for analytical analysis as described in Table 60.1.

TABLE 60.1

| All lysis, purification, reaction, quench, and analytical properties |
|---|
| Lysis and purification conditions : Lysis buffer - 20 mM Tris-acetate, pH 8, 0.2 g/L lysozyme from chicken egg white; Lysis buffer volume - 400 μL; Lysate pre-treatment - Lysates were preincubated at 60° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide - 4 pM TTTTTTTATC; Nucleotide triphosphate - 50 μM 3'PO4-dCTP; Reaction buffer - 20 mM MOPS, pH 7.2, 0.002 Unit/pL yeast pyrophosphatase (Thermo Scientific), 50 mM potassium acetate, 250 μM cobalt (II) chloride; Reaction volume - 36 μL ; Lysate dilution - 4× dilution prior to adding to the reaction; Reaction temperature - 60° C.; Reaction time - 15 minutes |
| Quench conditions: Quench solution and volume - Reactions were quenched by adding two volumes of 90% acetonitrile and 10% methanol mixture and clarifying by centrifugation; Plate type and seal - 384-well microtiter plate with a foil seal |
| Analytical conditions: Instrument - Agilent RapidFire SPE-MS/MS - see Example 6; Reaction product detected - TTTTTTTATCC-3'PO4 |

Activity relative to SEQ ID NO: 3074 (Activity FIOP) was calculated as the product peak area of the variant compared with the product peak area observed by the reaction with SEQ ID NO: 3074 (where the peak area may be set as the average of replicates or else the highest single sample as appropriate). The results are shown in Table 60.2.

TABLE 60.2

| SEQ ID NO: (nt/aa) | Amino Acid Differences (Relative to SEQ ID NO: 3074) | FIOP Product Peak Area Relative to SEQ ID NO: 3074 |
|---|---|---|
| 3215/3216 | 177V | +++ |
| 3217/3218 | Q32C | +++ |
| 3219/3220 | F78L | +++ |
| 3221/3222 | K272D | +++ |
| 3223/3224 | D103S | +++ |
| 3225/3226 | E106R | +++ |
| 3227/3228 | E111H | +++ |
| 3229/3230 | P29H | +++ |
| 3231/3232 | K79R | +++ |
| 3233/3234 | D103G | ++ |
| 3235/3236 | T17G | ++ |
| 3237/3238 | F48I | ++ |
| 3239/3240 | Q32P | ++ |
| 3241/3242 | E106Q | ++ |
| 3201/3202 | G373N | ++ |
| 3243/3244 | Y44R | ++ |
| 3245/3246 | E111V | ++ |
| 3247/3248 | K38R | ++ |
| 3249/3250 | S80W | ++ |
| 3251/3252 | E111N | ++ |
| 3253/3254 | E238D | ++ |
| 3255/3256 | V117I | ++ |
| 3257/3258 | F78L/K127R | + |
| 3203/3204 | N16M | + |
| 3259/3260 | E111S | + |
| 3261/3262 | E21N | + |
| 3263/3264 | S24T | + |
| 3265/3266 | I77L | + |
| 3267/3268 | P29S | + |
| 3269/3270 | E111M | + |
| 3271/3272 | E119A | + |
| 3273/3274 | S115R | + |
| 3275/3276 | V22Q | + |
| 3277/3278 | D103C | + |
| 3279/3280 | K20G | + |
| 3281/3282 | V22P | + |
| 3283/3284 | K20A | + |
| 3285/3286 | P18L | + |
| 3287/3288 | D103P | + |
| 3213/3214 | I210L | + |
| 3289/3290 | R28G | + |
| 3291/3292 | E106Y | + |
| 3293/3294 | G232T | + |
| 3295/3296 | Y44V | + |

TABLE 60.2-continued

| SEQ ID NO: (nt/aa) | Amino Acid Differences (Relative to SEQ ID NO: 3074) | FIOP Product Peak Area Relative to SEQ ID NO: 3074 |
|---|---|---|
| 3297/3298 | V22C | + |
| 3299/3300 | A27S | + |

Levels of increased activity were determined relative to the reference polypeptide of SEQ ID NO: 3074 and defined as follows: "+" 1.11 to 1.30, "++" > 1.30, "+++" > 1.70

Example 61

Improvements Over SEQ ID NO: 3074 in the Extension of Oligonucleotide Acceptor Molecules with Nucleotide Triphosphate Donors HTP Screening for Improved TdT Variants SEQ ID NO: 3074 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 61.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 61.1. The quenched reactions were centrifuged at 4,000 rpm for 10 min at 4° C. to pellet any precipitate. Supernatant was then transferred into new HTP plates for analytical analysis as described in Table 61.1.

TABLE 61.1

| All lysis, purification, reaction, quench, and analytical properties |
|---|
| Lysis and purification conditions : Lysis buffer - 20 mM Tris-acetate, pH 8, 0.2 g/L lysozyme from chicken egg white; Lysis buffer volume - 400 μL; Lysate pre-treatment - Lysates were preincubated at 56° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide - 4 μM TTTTTTTACA; Nucleotide triphosphate - 50 μM 3'PO4-dTTP; Reaction buffer - 20 mM MOPS, pH 7.2, 0.002 Unit/pL yeast pyrophosphatase (Thermo Scientific), 50 mM potassium acetate, 250 μM cobalt (II) chloride; Reaction volume - 36 μL ; Lysate dilution - 4× dilution prior to adding to the reaction; Reaction temperature - 56° C.; Reaction time - 15 minutes |
| Quench conditions: Quench solution and volume - Reactions were quenched by adding two volumes of 90% acetonitrile and 10% methanol mixture and clarifying by centrifugation; Plate type and seal - 384-well microtiter plate with a foil seal |
| Analytical conditions: Instrument - Agilent RapidFire SPE-MS/MS - see Example 6; Reaction product detected - TTTTTTTACAT-3'PO4 |

Activity relative to SEQ ID NO: 3074 (Activity FIOP) was calculated as the product peak area of the variant compared with the product peak area observed by the reaction with SEQ ID NO: 3074 (where the peak area may be set as the average of replicates or else the highest single sample as appropriate). The results are shown in Table 61.2.

TABLE 61.2

| SEQ ID NO: (nt/aa) | Amino Acid Differences (Relative to SEQ ID NO: 3074) | FIOP Product Peak Area Relative to SEQ ID NO: 3074 |
|---|---|---|
| 3301/3302 | F202V/M235E/A360R/R367G/K371S | +++ |
| 3303/3304 | F226L/K366E/F369Y/V387L | +++ |
| 3305/3306 | R233S/K371S | +++ |
| 3307/3308 | E111R/F226L/I321C/ L344T/R346I/F369Y/V387L | ++ |
| 3309/3310 | R233S/R367G/K371S | ++ |
| 3311/3312 | T201G/F202V/K272G/A360R | ++ |
| 3313/3314 | F226L | ++ |
| 3315/3316 | F226L/K366E | + |
| 3317/3318 | R367G/K371S | + |
| 3319/3320 | F226L/L268V | + |
| 3321/3322 | F202V/R233S | + |
| 3323/3324 | S162T/R367G/K371S | + |
| 3325/3326 | F226L/I321C/F369Y | + |
| 3327/3328 | L207A/M235E/F327Y/A360R/K371S | + |
| 3329/3330 | T201G/F202V | + |
| 3331/3332 | E111R/F226L | + |

Levels of increased activity were determined relative to the reference polypeptide of SEQ ID NO: 3074 and defined as follows: "+" 1.11 to 1.20, "++" > 1.20, "+++" > 1.30

Example 62

Improvements Over SEQ ID NO: 3302 in the Extension of Oligonucleotide Acceptor Molecules with Nucleotide Triphosphate Donors HTP Screening for Improved TdT Variants SEQ ID NO: 3302 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 62.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 62.1. The quenched reactions were centrifuged at 4,000 rpm for 10 min at 4° C. to pellet any precipitate. Supernatant was then transferred into new HTP plates for analytical analysis as described in Table 62.1.

TABLE 62.1

| All lysis, purification, reaction, quench, and analytical properties |
|---|
| Lysis and purification conditions : Lysis buffer - 20mM Tris-acetate, pH 8, 0.2 g/L lysozyme from chicken egg white; Lysis buffer volume - 400 uL; Lysate pre-treatment - Lysates were preincubated at 63° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide - 4 μM TTTTTTTATC; Nucleotide triphosphate - 50 μM 3'PO4-dCTP; Reaction buffer - 20 mM MOPS, pH 7.2, 0.002 Unit/pL yeast pyrophosphatase (Thermo Scientific), 50 mM potassium acetate, 250 μM cobalt (II) chloride; Reaction volume - 36 μL ; Lysate dilution - 2x dilution prior to adding to the reaction; Reaction temperature - 63° C.; Reaction time - 15 minutes |
| Quench conditions: Quench solution and volume - Reactions were quenched by adding two volumes of 90% acetonitrile and 10% methanol mixture and clarifying by centrifugation; Plate type and seal - 384-well microtiter plate with a foil seal |
| Analytical conditions: Instrument - Agilent RapidFire SPE-MS/MS - see Example 6; Reaction product detected - TTTTTTTATCC-3'PO4 |

Activity relative to SEQ ID NO: 3302 (Activity FIOP) was calculated as the product peak area of the variant compared with the product peak area observed by the reaction with SEQ ID NO: 3302 (where the peak area may be set as the average of replicates or else the highest single sample as appropriate). The results are shown in Table 62.2.

TABLE 62.2

| SEQ ID NO: (nt/aa) | Amino Acid Differences (Relative to SEQ ID NO: 3302) | FIOP Product Peak Area Relative to SEQ ID NO: 3302 |
|---|---|---|
| 3333/3334 | Ml 82G/F226L/E235T/L268V/R346I | +++ |
| 3335/3336 | M182G/T201R/V203A/F226L/E235T/R346I | +++ |
| 3337/3338 | M182G/T201R/F226L/L268V/R346I | +++ |
| 3339/3340 | M182G/T201R/F226L/E235T/R346I | +++ |
| 3341/3342 | M182G/T201R/V203A/L268I/R346I | +++ |
| 3343/3344 | Ml 82G/F226L/E235T/R346I | +++ |
| 3345/3346 | Ml 82G/T201R/V203A/F226L/E235T | +++ |
| 3347/3348 | M182G/T201R/V203A/ F226L/K234R/E235T/R346I | +++ |
| 3349/3350 | M182G/F226L/E235T | +++ |
| 3351/3352 | M182G/V203A/F226L | +++ |
| 3353/3354 | M182G/F226L/R346I | +++ |
| 3355/3356 | V203A/F226L/E235T/L268V/R346I | +++ |
| 3357/3358 | M182G/T201R/V203A/ F226L/K234H/E235T/R346I | ++ |
| 3359/3360 | F226L/L268I/R346I | ++ |
| 3361/3362 | Ml 82G/F226L/K234R/R346I | ++ |
| 3363/3364 | T201R/F226L/L268I/R346I | ++ |
| 3365/3366 | V104L/R200A/L207E/ D237R/L344M/G373A/V387L | ++ |
| 3367/3368 | F226L/E235T/L268V/R346I | ++ |
| 3369/3370 | L207E/V387L | ++ |
| 3371/3372 | F226L | ++ |
| 3373/3374 | M182G/F226L/K234R/L268I/R342V/R346I | ++ |
| 3375/3376 | L207E/R233S/D237R/L344M/V387I | ++ |
| 3377/3378 | F226L/R346I | ++ |
| 3379/3380 | Ml 82G/F226L/E235T/R342L | ++ |
| 3381/3382 | T201R/F226L/K234H/R346I | ++ |
| 3383/3384 | L207E | ++ |
| 3385/3386 | V104L/L207E/L344T/V3 87L | ++ |
| 3387/3388 | V203A/F226L/K234R/E235T | ++ |
| 3389/3390 | V203A/F226L/E235T/R346I | ++ |
| 3391/3392 | Ml 82G/F226L/L268I/R342V/R346I | ++ |
| 3393/3394 | M182G/F226L/R342V | ++ |
| 3395/3396 | V203A/F226L/R346I | + |
| 3397/3398 | K259R/M276L/V387L | + |
| 3399/3400 | F226L/E235T/L268I | + |
| 3401/3402 | T201R/V203A/L268I/R346I | + |
| 3403/3404 | T201R/V203A/F226L/K234H/R342V/R346I | + |
| 3405/3406 | M182G/T201R/V203A/F226L/R342V/R346I | + |
| 3407/3408 | T201R/F226L/K234R/R342L/R346I | + |
| 3409/3410 | T201R/V203A/F226L/K234H/R346I | + |
| 3411/3412 | F226L/L268I/R342L/R346I | + |
| 3413/3414 | F226L/E235T/R342V | + |
| 3415/3416 | F226L/R342V | + |
| 3417/3418 | F226L/R342V/R346I | + |
| 3419/3420 | F226L/L268I/R342V | + |
| 3421/3422 | F226L/E235T/L268V/R342L/R346I | + |
| 3423/3424 | M182G/T201R/V203A/ F226L/K234R/R342V/R346I | + |
| 3425/3426 | A75V | + |
| 3427/3428 | T201R/V203A/F226L/L268I/R342V | + |
| 3429/3430 | T201R/F226L/E235T/R342L | + |
| 3431/3432 | A75V/R233S/K366E | + |
| 3433/3434 | T201R/V203A/F226L/R346I | + |
| 3435/3436 | E106D/M182G/V203A/ F226L/E235T/R342L/R346I | + |
| 3437/3438 | M182G/T201R/F226L/K234H/R342V/R346I | + |
| 3439/3440 | A75V/R233S/L344T | + |
| 3441/3442 | M182G/T201R/R342V | + |
| 3443/3444 | V203A/F226L | + |
| 3445/3446 | M182G/R342L/R346I | + |
| 3447/3448 | V203A/F226L/K234H/E235T/R346I | + |
| 3449/3450 | R346I | + |
| 3451/3452 | V203A/F226L/R342V/R346I | + |
| 3453/3454 | V203A/F226L/E235T/R342L | + |
| 3455/3456 | F226L/L268V/R346I | + |

Levels of increased activity were determined relative to the reference polypeptide of SEQ ID NO: 3302 and defined as follows: "+" 1.01 to 1.70, "++" > 1.70, "+++" > 4.00

Example 63

Improvements Over SEQ ID NO: 3302 in the Extension of Oligonucleotide Acceptor Molecules with Nucleotide Triphosphate Donors HTP Screening for Improved TdT Variants SEQ ID NO: 3302 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 63.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 63.1. The quenched reactions were centrifuged at 4,000 rpm for 10 min at 4° C. to pellet any precipitate. Supernatant was then transferred into new HTP plates for analytical analysis as described in Table 63.1.

TABLE 63.1

| All lysis, purification, reaction, quench, and analytical properties |
|---|
| Lysis and purification conditions : Lysis buffer - 20mM Tris-acetate, pH 8, 0.2 g/L lysozyme from chicken egg white; Lysis buffer volume - 400 μL; Lysate pre-treatment - Lysates were preincubated at 60° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide - 4 μM TTTTTTTCGG; Nucleotide triphosphate - 50 μM 3' PO4-dGTP; Reaction buffer - 20 mM MOPS, pH 7.2, 0.002 Unit/pL yeast pyrophosphatase (Thermo Scientific), 50 mM potassium acetate, 250 pM cobalt (II) chloride; Reaction volume - 36 μL ; Lysate dilution - 8× dilution prior to adding to the reaction; Reaction temperature - 60° C.; Reaction time - 15 minutes |
| Quench conditions: Quench solution and volume - Reactions were quenched by adding two volumes of 90% acetonitrile and 10% methanol mixture and clarifying by centrifugation; Plate type and seal - 384-well microtiter plate with a foil seal |
| Analytical conditions: Instrument - Agilent RapidFire SPE-MS/MS - see Example 6; Reaction product detected - TTTTTTTCGGG-3'PO4 |

Activity relative to SEQ ID NO: 3302 (Activity FIOP) was calculated as the product peak area of the variant compared with the product peak area observed by the reaction with SEQ ID NO: 3302 (where the peak area may be set as the average of replicates or else the highest single sample as appropriate). The results are shown in Table 63.2.

TABLE 63.2

| SEQ ID NO: (nt/aa) | Amino Acid Differences (Relative to SEQ ID NO: 3302) | FIOP Product Peak Area Relative to SEQ ID NO: 3302 |
|---|---|---|
| 3333/3334 | Ml 82G/F226L/E235T/L268V/R346I | +++ |
| 3337/3338 | M182G/T201R/F226L/L268V/R346I | +++ |
| 3339/3340 | M182G/T201R/F226L/E235T/R346I | +++ |
| 3347/3348 | M182G/T201R/V203A/F226L/K234R/E235T/R346I | +++ |
| 3335/3336 | M182G/T201R/V203A/F226L/E235T/R346I | +++ |
| 3343/3344 | M182G/F226L/E235T/R346I | +++ |
| 3341/3342 | M182G/T201R/V203A/L26 8I/R346I | +++ |
| 3345/3346 | M182G/T201R/V203A/F226L/E235T | +++ |
| 3353/3354 | M182G/F226L/R346I | +++ |
| 3351/3352 | M182G/V203A/F226L | ++ |
| 3367/3368 | F226L/E235T/L268V/R346I | ++ |
| 3349/3350 | M182G/F226L/E235T | ++ |
| 3365/3366 | V104L/R200A/L207E/D237R/L344M/G373A/V387L | ++ |
| 3369/3370 | L207E/V387L | ++ |
| 3359/3360 | F226L/L268I/R346I | ++ |
| 3361/3362 | M182G/F226L/K234R/R346I | ++ |
| 3395/3396 | V203A/F226L/R346I | ++ |
| 3355/3356 | V203A/F226L/E235T/L268V/R346I | ++ |
| 3375/3376 | L207E/R233S/D237R/L344M/V387I | ++ |
| 3363/3364 | T201R/F226L/L268I/R346I | ++ |
| 3393/3394 | M182G/F226L/R342V | ++ |
| 3357/3358 | M182G/T201R/V203A/F226L/K234H/E235T/R346I | ++ |
| 3371/3372 | F226L | ++ |
| 3457/3458 | M182G/F226L/L268I/R342V/R346I | ++ |
| 3387/3388 | V203A/F226L/K234R/E235T | ++ |
| 3407/3408 | T201R/F226L/K234R/R342L/R346I | + |
| 3417/3418 | F226L/R342V/R3461 | + |
| 3383/3384 | L207E | + |
| 3377/3378 | F226L/R346I | + |
| 3459/3460 | V203A/F226L/E235T/R346I | + |
| 3399/3400 | F226L/E235T/L268I | + |
| 3373/3374 | M182G/F226L/K234R/L268I/R342V/R346I | + |
| 3423/3424 | M182G/T201R/V203A/F226L/K234R/R342V/R346I | + |
| 3379/3380 | M182G/F226L/E235T/R342L | + |
| 3385/3386 | V104L/L207E/L344T/V3 87L | + |
| 3455/3456 | F226L/L268V/R346I | + |
| 3461/3462 | F226L/E235T/R346I | + |
| 3431/3432 | A75V/R233S/K366E | + |
| 3443/3444 | V203A/F226L | + |
| 3437/3438 | M182G/T201R/F226L/K234H/R342V/R346I | + |
| 3439/3440 | A75V/R233S/L344T | + |
| 3381/3382 | T201R/F226L/K234H/R346I | + |

255

TABLE 63.2-continued

| SEQ ID NO: (nt/aa) | Amino Acid Differences (Relative to SEQ ID NO: 3302) | FIOP Product Peak Area Relative to SEQ ID NO: 3302 |
|---|---|---|
| 3397/3398 | K259R/M276L/V387L | + |
| 3463/3464 | F226L/K234R/R342V | + |
| 3465/3466 | M182G/F226L/K234H/R346I | + |
| 3403/3404 | T201R/V203A/F226L/K234H/R342V/R346I | + |
| 3405/3406 | M182G/T201R/V203A/F226L/R342V/R346I | + |
| 3467/3468 | T201R/V203A/L268V/R342V | + |
| 3401/3402 | T201R/V203A/L268I/R346I | + |
| 3441/3442 | M182G/T201R/R342V | + |
| 3419/3420 | F226L/L268I/R342V | + |
| 3433/3434 | T201R/V203A/F226L/R346I | + |
| 3429/3430 | T201R/F226L/E235T/R342L | + |

Levels of increased activity were determined relative to the reference polypeptide of SEQ ID NO: 3302 and defined as follows: "+" 1.01 to 1.75, "++" > 1.75, "+++" > 3.50

Example 64

Improvements Over SEQ ID NO: 3302 in the Extension of Oligonucleotide Acceptor Molecules with Nucleotide Triphosphate Donors HTP Screening for Improved TdT Variants SEQ ID NO: 3302 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 64.1.

Reactions were performed in 96-well format 200 µL BioRad PCR plates. Reactions included 1-4 µM oligonucleotide, 25-200 µM nucleotide triphosphate, 0.002 Unit/µL yeast pyrophosphatase (Thermo Scientific), 20 mM buffer, 50 mM potassium acetate, and 250 µM cobalt (II) chloride. The reactions were set up as follows: (i) all reaction components, except for TdT, were pre-mixed in a single solution, and 15 µL of this solution was aliquoted into each well of the 96-well plates (ii) 5 µL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 64.1. The quenched reactions were centrifuged at 4,000 rpm for 10 min at 4° C. to pellet any precipitate. Supernatant was then transferred into new HTP plates for analytical analysis as described in Table 64.1.

TABLE 64.1

All lysis, purification, reaction, quench, and analytical properties

Lysis and purification conditions : Lysis buffer - 20mM Tris-acetate, pH 8, 0.2 g/L lysozyme from chicken egg white; Lysis buffer volume - 400 µL; Lysate pre-treatment - Lysates were preincubated at 60° C. for one hour, then centrifuged at 4,000 rpm for 10 min as described in Example 2 [Lysis of HTP Cell Pellets with Lysozyme]. The clarified supernatants were used in reactions.
Reaction conditions: Oligonucleotide - 4 pM TTTTTTTATG; Nucleotide triphosphate - 50 µM 3'PO4-dATP; Reaction buffer - 20 mM MOPS, pH 7.2, 0.002 Unit/pL yeast pyrophosphatase (Thermo Scientific), 50 mM potassium acetate, 250 µM cobalt (II) chloride; Reaction volume - 36 µL ; Lysate dilution - 8× dilution prior to adding to the reaction; Reaction temperature - 60° C.; Reaction time - 15 minutes
Quench conditions: Quench solution and volume - Reactions were quenched by adding two volumes of 90% acetonitrile and 10% methanol mixture and clarifying by centrifugation; Plate type and seal - 384-well microtiter plate with a foil seal
Analytical conditions: Instrument - Agilent RapidFire SPE-MS/MS - see Example 6; Reaction product detected - TTTTTTTATGA-3'PO4

Activity relative to SEQ ID NO: 3302 (Activity FIOP) was calculated as the product peak area of the variant compared with the product peak area observed by the reaction with SEQ ID NO: 3302 (where the peak area may be set as the average of replicates or else the highest single sample as appropriate). The results are shown in Table 64.2.

TABLE 64.2

| SEQ ID NO: (nt/aa) | Amino Acid Differences (Relative to SEQ ID NO: 3302) | FIOP Product Peak Area Relative to SEQ ID NO: 3302 |
|---|---|---|
| 3337/3338 | M182G/T201R/F226L/L268V/R346I | +++ |
| 3333/3334 | M182G/F226L/E235T/L268V/R346I | +++ |
| 3335/3336 | M182G/T201R/V203A/F226L/E235T/R346I | +++ |
| 3345/3346 | M182G/T201R/V203A/F226L/E235T | +++ |
| 3341/3342 | M182G/T201R/V203A/L268I/R346I | +++ |
| 3343/3344 | M182G/F226L/E235T/R346I | +++ |
| 3339/3340 | M182G/T201R/F226L/E235T/R346I | +++ |
| 3347/3348 | M182G/T201R/V203A/ F226L/K234R/E235T/R346I | +++ |
| 3353/3354 | M182G/F226L/R346I | +++ |
| 3349/3350 | M182G/F226L/E235T | +++ |
| 3351/3352 | M182G/V203A/F226L | ++ |
| 3361/3362 | M182G/F226L/K234R/R346I | ++ |

TABLE 64.2-continued

| SEQ ID NO: (nt/aa) | Amino Acid Differences (Relative to SEQ ID NO: 3302) | FIOP Product Peak Area Relative to SEQ ID NO: 3302 |
|---|---|---|
| 3365/3366 | V104L/R200A/L207E/D237R/L344M/G373A/V387L | ++ |
| 3357/3358 | M182G/T201R/V203A/F226L/K234H/E235T/R346I | ++ |
| 3355/3356 | V203A/F226L/E235T/L268V/R346I | ++ |
| 3367/3368 | F226L/E235T/L268V/R346I | ++ |
| 3369/3370 | L207E/V387L | ++ |
| 3375/3376 | L207E/R233S/D237R/L344M/V387I | ++ |
| 3359/3360 | F226L/L268I/R346I | ++ |
| 3363/3364 | T201R/F226L/L268I/R346I | ++ |
| 3385/3386 | V104L/L207E/L344T/V3 87L | ++ |
| 3397/3398 | K259R/M276L/V387L | ++ |
| 3399/3400 | F226L/E235T/L268I | ++ |
| 3387/3388 | V203A/F226L/K234R/E235T | ++ |
| 3389/3390 | V203A/F226L/E235T/R346I | ++ |
| 3465/3466 | M182G/F226L/K234H/R346I | ++ |
| 3383/3384 | L207E | + |
| 3395/3396 | V203A/F226L/R346I | + |
| 3393/3394 | M182G/F226L/R342V | + |
| 3371/3372 | F226L | + |
| 3455/3456 | F226L/L268V/R346I | + |
| 3379/3380 | M182G/F226L/E235T/R342L | + |
| 3461/3462 | F226L/E235T/R346I | + |
| 3401/3402 | T201R/V203A/L268I/R346I | + |
| 3457/3458 | M182G/F226L/L268I/R342V/R346I | + |
| 3469/3470 | F226L/K234R/E235T/R346I | + |
| 3407/3408 | T201R/F226L/K234R/R342L/R346I | + |
| 3433/3434 | T201R/V203A/F226L/R346I | + |
| 3443/3444 | V203A/F226L | + |
| 3377/3378 | F226L/R346I | + |
| 3423/3424 | M182G/T201R/V203A/F226L/K234R/R342V/R346I | + |
| 3413/3414 | F226L/E235T/R342V | + |
| 3467/3468 | T201R/V203A/L268V/R342V | + |
| 3471/3472 | T201R/F226L/R346I | + |
| 3373/3374 | M182G/F226L/K234R/L268I/R342V/R346I | + |
| 3415/3416 | F226L/R342V | + |
| 3437/3438 | M182G/T201R/F226L/K234H/R342V/R346I | + |
| 3419/3420 | F226L/L268I/R342V | + |
| 3405/3406 | M182G/T201R/V203A/F226L/R342V/R346I | + |
| 3473/3474 | T201R/V203A/F226L/K234H | + |
| 3447/3448 | V203A/F226L/K234H/E235T/R346I | + |
| 3417/3418 | F226L/R342V/R346I | + |
| 3475/3476 | A75V/L207E/G373A/I378V | + |

Levels of increased activity were determined relative to the reference polypeptide of SEQ ID NO: 3302 and defined as follows: "+" 1.02 to 3.00, "++" > 3.00, "+++" > 9.50

Example 65

Improvements Over SEQ ID NO: 3302 in the Extension of Oligonucleotide Acceptor Molecules with Nucleotide Triphosphate Donors HTP Screening for Improved TdT Variants SEQ ID NO: 3302 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 65.1.

Reactions were performed in 96-well format 200 µL BioRad PCR plates. Reactions included 1-4 µM oligonucleotide, 25-200 µM nucleotide triphosphate, 0.002 Unit/µL yeast pyrophosphatase (Thermo Scientific), 20 mM buffer, 50 mM potassium acetate, and 250 µM cobalt (11) chloride. The reactions were set up as follows: (i) all reaction components, except for TdT, were pre-mixed in a single solution, and 15 µL of this solution was aliquoted into each well of the 96-well plates (ii) 5 µL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 65.1. The quenched reactions were centrifuged at 4,000 rpm for 10 min at 4° C. to pellet any precipitate. Supernatant was then transferred into new HTP plates for analytical analysis as described in Table 65.1.

TABLE 65.1

| All lysis, purification, reaction, quench, and analytical properties |
|---|
| Lysis and purification conditions : Lysis buffer - 20mM Tris-acetate, pH 8, 0.2 g/L lysozyme from chicken egg white; Lysis buffer volume - 400 μL; Lysate pre-treatment - Lysates were preincubated at 60° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide - 4 μM TTTTTTTACA; Nucleotide triphosphate - 50 μM 3'PO4-dTTP; Reaction buffer - 20 mM MOPS, pH 7.2, 0.002 Unit/pL yeast pyrophosphatase (Thermo Scientific), 50 mM potassium acetate, 250 μM cobalt (II) chloride; Reaction volume - 36 μL ; Lysate dilution - 8× dilution prior to adding to the reaction; Reaction temperature - 60° C.; Reaction time - 15 minutes |
| Quench conditions: Quench solution and volume - Reactions were quenched by adding two volumes of 90% acetonitrile and 10% methanol mixture and clarifying by centrifugation; Plate type and seal - 384-well microtiter plate with a foil seal |
| Analytical conditions: Instrument - Agilent RapidFire SPE-MS/MS - see Example 6; Reaction product detected - TTTTTTTACAT-3'PO4 |

Activity relative to SEQ ID NO: 3302 (Activity FIOP) was calculated as the product peak area of the variant compared with the product peak area observed by the reaction with SEQ ID NO: 3302 (where the peak area may be set as the average of replicates or else the highest single sample as appropriate). The results are shown in Table 65.2.

TABLE 65.2

| SEQ ID NO: (nt/aa) | Amino Acid Differences (Relative to SEQ ID NO: 3302) | FIOP Product Peak Area Relative to SEQ ID NO: 3302 |
|---|---|---|
| 3333/3334 | M182G/F226L/E235T/L268V/R346I | +++ |
| 3337/3338 | M182G/T201R/F226L/L268V/R346I | +++ |
| 3341/3342 | M182G/T201R/V203A/L268I/R346I | +++ |
| 3335/3336 | M182G/T201R/V203A/F226L/E235T/R346I | +++ |
| 3343/3344 | M182G/F226L/E235T/R346I | +++ |
| 3339/3340 | M182G/T201R/F226L/E235T/R346I | +++ |
| 3345/3346 | M182G/T201R/V203A/F226L/E235T | +++ |
| 3347/3348 | M182G/T201R/V203A/ F226L/K234R/E235T/R346I | +++ |
| 3353/3354 | M182G/F226L/R346I | +++ |
| 3367/3368 | F226L/E235T/L268V/R346I | +++ |
| 3355/3356 | V203A/F226L/E235T/L268V/R346I | +++ |
| 3361/3362 | M182G/F226L/K234R/R346I | +++ |
| 3365/3366 | V104L/R200A/L207E/ D237R/L344M/G373A/V387L | ++ |
| 3359/3360 | F226L/L268I/R346I | ++ |
| 3477/3478 | T201R/F226L/L268I/R346I | ++ |
| 3351/3352 | M182G/V203A/F226L | ++ |
| 3375/3376 | L207E/R233S/D237R/L344M/V387I | ++ |
| 3357/3358 | M182G/T201R/V203A/ F226L/K234H/E235T/R346I | ++ |
| 3349/3350 | M182G/F226L/E235T | ++ |
| 3369/3370 | L207E/V387L | ++ |
| 3395/3396 | V203A/F226L/R346I | ++ |
| 3399/3400 | F226L/E235T/L268I | ++ |
| 3387/3388 | V203A/F226L/K234R/E235T | ++ |
| 3389/3390 | V203A/F226L/E235T/R346I | ++ |
| 3397/3398 | K259R/M276L/V387L | ++ |
| 3401/3402 | T201R/V203A/L268I/R346I | ++ |
| 3465/3466 | M182G/F226L/K234H/R346I | ++ |
| 3393/3394 | M182G/F226L/R342V | ++ |
| 3385/3386 | V104L/L207E/L344T/V3 87L | ++ |
| 3371/3372 | F226L | ++ |
| 3457/3458 | M182G/F226L/L268I/R342V/R346I | ++ |
| 3407/3408 | T201R/F226L/K234R/R342L/R346I | + |
| 3455/3456 | F226L/L268V/R346I | + |
| 3461/3462 | F226L/E235T/R346I | + |
| 3417/3418 | F226L/R342V/R3461 | + |
| 3433/3434 | T201R/V203A/F226L/R346I | + |
| 3383/3384 | L207E | + |
| 3469/3470 | F226L/K234R/E235T/R346I | + |
| 3423/3424 | M182G/T201R/V203A/ F226L/K234R/R342V/R346I | + |
| 3377/3378 | F226L/R346I | + |

TABLE 65.2-continued

| SEQ ID NO: (nt/aa) | Amino Acid Differences (Relative to SEQ ID NO: 3302) | FIOP Product Peak Area Relative to SEQ ID NO: 3302 |
|---|---|---|
| 3437/3438 | M182G/T201R/F226L/K234H/R342V/R346I | + |
| 3439/3440 | A75V/R233S/L344T | + |
| 3405/3406 | M182G/T201R/V203A/F226L/R342V/R346I | + |
| 3373/3374 | M182G/F226L/K234R/L268I/R342V/R346I | + |
| 3471/3472 | T201R/F226L/R346I | + |
| 3379/3380 | M182G/F226L/E235T/R342L | + |
| 3443/3444 | V203A/F226L | + |
| 3447/3448 | V203A/F226L/K234H/E235T/R346I | + |
| 3415/3416 | F226L/R342V | + |
| 3431/3432 | A75V/R233S/K366E | + |
| 3467/3468 | T201R/V203A/L268V/R342V | + |
| 3445/3446 | M182G/R342L/R346I | + |
| 3451/3452 | V203A/F226L/R342V/R346I | + |
| 3479/3480 | T201R/E235T/L268V/R342V/R346I | + |
| 3413/3414 | F226L/E235T/R342V | + |
| 3463/3464 | F226L/K234R/R342V | + |
| 3429/3430 | T201R/F226L/E235T/R342L | + |
| 3435/3436 | E106D/M182G/ V203A/F226L/E235T/R342L/R346I | + |
| 3427/3428 | T201R/V203A/F226L/L268I/R342V | + |
| 3481/3482 | F226L/K234H/R342L | + |
| 3419/3420 | F226L/L268I/R342V | + |
| 3441/3442 | M182G/T201R/R342V | + |
| 3483/3484 | F226L/L268V/R342L | + |

Levels of increased activity were determined relative to the reference polypeptide of SEQ ID NO: 3302 and defined as follows: "+" 1.00 to 1.75, "++" > 1.75, "+++" > 3.50

Example 66

Improvements Over SEQ ID NO: 3398 in the Extension of Oligonucleotide Acceptor Molecules with Nucleotide Triphosphate Donors HTP Screening for Improved TdT Variants SEQ ID NO: 3398 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 66.1.

Reactions were performed in 96-well format 200 μL BioRad PCR plates. Reactions included 1-4 μM oligonucleotide, 25-200 μM nucleotide triphosphate, 0.002 Unit/μL yeast pyrophosphatase (Thermo Scientific), 20 mM buffer, 50 mM potassium acetate, and 250 μM cobalt (11) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 66.1. The quenched reactions were centrifuged at 4,000 rpm for 10 min at 4° C. to pellet any precipitate. Supernatant was then transferred into new HTP plates for analytical analysis as described in Table 66.1.

TABLE 66.1

| All lysis, purification, reaction, quench, and analytical properties |
|---|
| Lysis and purification conditions : Lysis buffer - 20 mM Tris-acetate, pH 8, 0.2 g/L lysozyme from chicken egg white; Lysis buffer volume - 400 μL; Lysate pre-treatment - Lysates were preincubated at 60° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide - 4 μM TTTTTTTCGG; Nucleotide triphosphate - 50 μM 3'PO4-dGTP; Reaction buffer - 20 mM MOPS, pH 7.2, 0.002 Unit/pL yeast pyrophosphatase (Thermo Scientific), 50 mM potassium acetate, 250 μM cobalt (II) chloride; Reaction volume - 36 μL ; Lysate dilution - 4× dilution prior to adding to the reaction; Reaction temperature - 60° C.; Reaction time - 15 minutes |
| Quench conditions: Quench solution and volume - Reactions were quenched by adding two volumes of 90% acetonitrile and 10% methanol mixture and clarifying by centrifugation; Plate type and seal - 384-well microtiter plate with a foil seal |
| Analytical conditions: Instrument - Agilent RapidFire SPE-MS/MS - see Example 6; Reaction product detected - TTTTTTTCGGG-3'PO4 |

Activity relative to SEQ ID NO: 3398 (Activity FIOP) was calculated as the product peak area of the variant compared with the product peak area observed by the reaction with SEQ ID NO: 3398 (where the peak area may be set as the average of replicates or else the highest single sample as appropriate). The results are shown in Table 66.2.

TABLE 66

| SEQ ID NO: (nt/aa) | Amino Acid Differences (Relative to SEQ ID NO: 3398) | FIOP Product Peak Area Relative to SEQ ID NO: 3398 |
|---|---|---|
| 3485/3486 | P29H/I77V/K234H/H271P/F279H/I368Q | +++ |
| 3487/3488 | P29H/M182G/K234P/H271P/A380G | +++ |
| 3489/3490 | Ml 82G/L207E/F279H/I368Q | +++ |
| 3491/3492 | M182G/F279H/I368Q/A380G | +++ |
| 3493/3494 | P29H/I77V/V104L/K234R/ H271P/F279H/A380G | +++ |
| 3495/3496 | I77V/M182G/I368Q | +++ |
| 3497/3498 | I77V/M182G/F279H/A380G | +++ |
| 3499/3500 | P29H/M182G/H271Q/F279H/A3 80G | +++ |
| 3501/3502 | P29H/177V/H271P | +++ |
| 3503/3504 | P29H/I77V/M182G/L207E/H271Q | ++ |
| 3505/3506 | 177V/K234H/H271Q/F279H/A3 80G | ++ |
| 3507/3508 | Q32P/F78L/R200A/F226L/ E235T/I321M/G373N | ++ |
| 3509/3510 | R200A/F226L | ++ |
| 3511/3512 | Q32C/E106Q/R200A/F226L/E235T/G373N | ++ |
| 3513/3514 | E106R/F226L/E235T/G373A | ++ |
| 3515/3516 | P29H/H271Q/F279H/I368Q/A380G | ++ |
| 3517/3518 | R200A/F226L/I321M/G373N | ++ |
| 3519/3520 | H271P/A380G | ++ |
| 3521/3522 | P29H/I77V/L207E/K234H/F279H/A380G | ++ |
| 3523/3524 | V104L/M182G | ++ |
| 3525/3526 | F78L/E106R/F226L/I321M/G373N | ++ |
| 3527/3528 | P29H/K234H/F279H/A380G | ++ |
| 3529/3530 | M182G/K234R/A380G | ++ |
| 3531/3532 | Q32P/R200A/F226L/I321M/G373N | ++ |
| 3533/3534 | Q32P/F226L | ++ |
| 3535/3536 | P29H/V104L/K234R/H271Q/F279H/A380G | + |
| 3537/3538 | F78L/R200A/F226L/I321M/G373N | + |
| 3539/3540 | F78L/E106R/F226L/I321M/G373A | + |
| 3541/3542 | P29H/H271Q/F279H | + |
| 3543/3544 | Q32P/F78L/F226L/G373N | + |
| 3545/3546 | Q32P/F78L/F226L | + |
| 3547/3548 | E106R/R200A/F226L/G373A | + |
| 3549/3550 | F226L | + |
| 3551/3552 | Q32P/R200A/F226L | + |
| 3553/3554 | Q32P/F78L/E106Q/F226L | + |

TABLE 66-continued

| SEQ ID NO: (nt/aa) | Amino Acid Differences (Relative to SEQ ID NO: 3398) | FIOP Product Peak Area Relative to SEQ ID NO: 3398 |
|---|---|---|
| 3555/3556 | P29H/I77 V/V104L/K234P/H27 IP | + |
| 3557/3558 | Q32P/F78L/E106R/R200A/ F226L/K272D/G373N | + |
| 3559/3560 | P29H/M182G/L207E/A380G | + |
| 3561/3562 | Q32C/F78L/R200A/F226L | + |
| 3563/3564 | F78L/E106Q | + |
| 3565/3566 | Q32C/F78L/F226L/G373N | + |
| 3567/3568 | L207E/A380G | + |
| 3569/3570 | Q32C/E106R/R200A/F226L | + |
| 3571/3572 | F78L/E106R/E235T/I321M/G373N | + |
| 3573/3574 | F226L/K272D/G373N | + |
| 3575/3576 | Q32P/F78L/E106R/R200A/F226L/G373A | + |
| 3577/3578 | F226L/E235T/K272D/G373A | + |
| 3579/3580 | F78L/F226L/I321M | + |
| 3581/3582 | Q32C/F78L/R200A/F226L/E235T/K272D | + |
| 3583/3584 | R200A/F226L/G373A | + |
| 3585/3586 | Q32C/F78L/F226L/I321M | + |
| 3587/3588 | Q32C/F78L/E106R/R200A/F226L/G373N | + |
| 3589/3590 | L207E/H271Q/I368Q/A380G | + |

Levels of increased activity were determined relative to the reference polypeptide of SEQ ID NO: 3398 and defined as follows: "+" 1.14 to 1.30, "++" > 1.30, "+++" > 1.50

Example 67

Screening of Shake-Flask Purified TdTs for the Reduction of by-Products Generated by the TdT-Dependent Pyrophosphorolysis Reaction Screening G341X TdT Variants for Improved by-Product Profiles TdTs were selected from the library in Example 32 for shake flask purification and screening against by-products formed including those formed, for example, by a TdT-dependent pyrophosphorolysis reaction. Shake flasks were grown, lysed, and purified as described in Example 3.

Reactions were performed in 96-well format 200 μL BioRad PCR plates. Reactions included 2 μM oligonucleotide, 50 μM nucleotide triphosphate, TdT solution, 0.002 Unit/μL *E. coli* pyrophosphatase (New England Biolabs), 20 mM MOPS, 50 mM potassium acetate, and 250 μM cobalt (I1) chloride. The reactions were set up as follows: (i) all reaction components, except for TdT, were pre-mixed in a single solution, and 15 μL of this solution was aliquoted into each well of the 96-well plates (ii) 5 μL of TdT solution (4× concentration in 20 mM MOPS, pH 7.2) was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 67.1. Supernatant was then transferred into new HTP plates for analytical analysis as described in Table 67.2.

TABLE 67.1

| Reaction, quench, and analytical properties (condition 1, ACA, A) |
|---|
| Reaction conditions: Oligonucleotide - 2 μM TTTTTTTACA; Nucleotide triphosphate - 50 μM 3'PO4-dATP; Reaction buffer - 20 mM MOPS, pH 7.2, 0.002 Unit/pL *E. coli* pyrophosphatase (New England Biolabs), 50 mM potassium acetate, 250 μM cobalt (II) chloride; Reaction volume - 20 μL ; TdT concentration - 1.3 pM ; Reaction temperature - 46° C.; Reaction time - 15 minutes |
| Quench conditions: Quench solution and volume - Reactions were quenched by the addition of 30 μL methanol and 5 μL of 100 mM aqueous EDTA. After centrifugation at 4,000 rpm for 10 min at 4° C., 32 μL of the supernatant transferred to a new plate and further diluted by the addition of 18 μL water.; Plate type and seal - 96-well BioRad PCR plate with a plastic seal |
| Analytical conditions: Instrument - Agilent UHPLC 1260 prime series, Agilent Ultivo - see Example 4; Reaction product and by-products detected - TTTTTTTACA (substrate), TTTTTTTACAA-3'PO4 (product), TTTTTTTACAA (by-product), TTTTTTTACAAA (by-product), TTTTTTTACAAA-3'PO4 (by-product) |

TABLE 67.2

| Reaction, quench, and analytical properties (condition 2, ATC, C) |
|---|
| Reaction conditions: Oligonucleotide - 2 μM TTTTTTTATC; Nucleotide triphosphate - 50 μM 3'PO4-dCTP; Reaction buffer - 20 mM MOPS, pH 7.2, 0.002 Unit/μL *E. coli* pyrophosphatase (New England Biolabs), 50 mM potassium acetate, 250 μM cobalt (II) chloride; Reaction volume - 20 μL; TdT |

TABLE 67.2-continued

| Reaction, quench, and analytical properties (condition 2, ATC, C) |
| --- |
| concentration - 1.3 μM; Reaction temperature - 46° C.; Reaction time - 15 minutes<br>Quench conditions: Quench solution and volume - Reactions were quenched by the addition of 30 μL methanol and 5 μL of 100 mM aqueous EDTA. After centrifugation at 4,000 rpm for 10 min at 4° C., 32 μL of the supernatant transferred to a new plate and further diluted by the addition of 18 μL water.; Plate type and seal - 96-well BioRad PCR plate with a plastic seal<br>Analytical conditions: Instrument - Agilent UHPLC 1260 prime series, Agilent Ultivo - see Example 4; Reaction product and by-products detected - TTTTTTTATC (substrate), TTTTTTTATCC-3'PO4 (product), TTTTTTTATCC (by-product), TTTTTTTATCCC (by-product), TTTTTTTATCCC-3'PO4 (by-product) |

Percent product and by-product were calculated as the peak area of product or summed peak areas of by-products divided by the summed area of all analytes multiplied by 100. The ratio of the percent product to percent by-products was calculated for each variant and compared with the equivalent product/by-product ratio observed for SEQ ID NO: 1678 (where fold-improvement-over-parent or FIOP is equal to the product/by-product ratio of the variant divided by the product/by-product ratio of SEQ ID NO: 1678). The results are shown in Table 67.3 and 67.4.

TABLE 67.3

(condition 1, ACA, A)

| SEQ ID NO: (nt/aa) | Amino Acid Differences (Relative to SEQ ID NO: 1678) | FIOP % Product/ % By-Product Relative to SEQ ID NO: 1678 |
| --- | --- | --- |
| 1699/1700 | G341R | +++ |
| 1693/1694 | G341K | ++ |
| 1695/1696 | G341V | ++ |
| 3591/3592 | G341S | + |
| 1701/1702 | G341L | + |
| 1697/1698 | G341I | + |

Levels of increased product/by-product ratio were determined relative to the reference polypeptide of SEQ ID NO: 1678 and defined as follows: "+" 1.28 to 2.00, "++" >2.00, "+++" >5.00

TABLE 67.4

(condition 2, ATC, C)

| SEQ ID NO: (nt/aa) | Amino Acid Differences (Relative to SEQ ID NO: 1678) | FIOP % Product/ % By-Product Relative to SEQ ID NO: 1678 |
| --- | --- | --- |
| 1699/1700 | G341R | +++ |
| 1695/1696 | G341V | ++ |
| 1693/1694 | G341K | ++ |
| 1701/1702 | G341L | + |
| 3591/3592 | G341S | + |
| 1697/1698 | G341I | + |

Levels of increased product/by-product ratio were determined relative to the reference polypeptide of SEQ ID NO: 1678 and defined as follows: "+" 1.85 to 3.00, "++" >3.00, "+++" >6.00

Example 68

Screening of a Shake-Flask Purified TdT for the Reduction of by-Products Generated by the TdT-Dependent Pyrophosphorolysis Reaction Screening a K338G TdT Variant for Improved by-Product Profiles TdT SEQ ID NO: 1882 was selected from the library in Example 35 for shake flask purification and screening against by-products including those formed, for example, by a TdT-dependent pyrophosphorolysis reaction. The shake flask expressing TdT SEQ ID NO: 1882 was grown, lysed, and purified as described in Example 3. The purified TdT enzyme was screened for activity and by-product formation.

Reactions were performed in 96-well format 200 μL BioRad PCR plates. Reactions included 2 μM oligonucleotide, 50 μM nucleotide triphosphate, TdT solution, 0.002 Unit/μL *E. coli* pyrophosphatase (New England Biolabs), 20 mM MOPS, 50 mM potassium acetate, and 250 μM cobalt (I1) chloride. The reactions were set up as follows: (i) all reaction components, except for TdT, were pre-mixed in a single solution, and 15 μL of this solution was aliquoted into each well of the 96-well plates (ii) 5 μL of TdT solution (4× concentration in 20 mM MOPS, pH 7.2) was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 68.1. Supernatant was then transferred into new HTP plates for analytical analysis as described in Table 68.2.

TABLE 68.1

| Reaction, quench, and analytical properties (condition 1 ACA, A) |
| --- |
| Reaction conditions: Oligonucleotide - 2 μM TTTTTTTACA; Nucleotide triphosphate - 50 μM 3'PO4-dATP; Reaction buffer - 20 mM MOPS, pH 7.2, 0.002 Unit/μL *E. coli* pyrophosphatase (New England Biolabs), 50 mM potassium acetate, 250 μM cobalt (II) chloride; Reaction volume - 20 μL; TdT concentration - 2 μM; Reaction temperature - 50° C.; Reaction time - 10 minutes<br>Quench conditions: Quench solution and volume - Reactions were quenched by the addition of 30 μL methanol and 5 μL of 100 mM aqueous EDTA. After centrifugation at 4,000 rpm for 10 min at 4° C., 32 μL of the supernatant transferred to a new plate and further diluted by the addition of 18 μL water.; Plate type and seal - 96-well BioRad PCR plate with a plastic seal<br>Analytical conditions: Instrument - Agilent UHPLC 1260 prime series, Agilent Ultivo - see Example |

TABLE 68.1-continued

| Reaction, quench, and analytical properties (condition 1 ACA, A) |
|---|
| 4; Reaction product and by-products detected - TTTTTTTACA (substrate), TTTTTTTACAA-3'PO4 (product), TTTTTTTAC (by-product), TTTTTTTACAA (by-product), TTTTTTTACAAA-3'PO4 (by-product) |

TABLE 68.2

| Reaction, quench, and analytical properties (condition 2, ACA, T) |
|---|
| Reaction conditions: Oligonucleotide - 2 µM TTTTTTTACA; Nucleotide triphosphate - 50 µM 3'PO4-dTTP; Reaction buffer - 20 mM MOPS, pH 7.2, 0.002 Unit/µL *E. coli* pyrophosphatase (New England Biolabs), 50 mM potassium acetate, 250 µM cobalt (II) chloride; Reaction volume - 20 µL; TdT concentration - 2 µM; Reaction temperature - 50° C.; Reaction time - 10 minutes |
| Quench conditions: Quench solution and volume - Reactions were quenched by the addition of 30 µL methanol and 5 µL of 100 mM aqueous EDTA. After centrifugation at 4,000 rpm for 10 min at 4° C., 32 µL of the supernatant transferred to a new plate and further diluted by the addition of 18 µL water.; Plate type and seal - 96-well BioRad PCR plate with a plastic seal |
| Analytical conditions: Instrument - Agilent UHPLC 1260 prime series, Agilent Ultivo - see Example 4; Reaction product and by-products detected - TTTTTTTACA (substrate), TTTTTTTACAT-3'PO4 (product), TTTTTTTAC (by-product), TTTTTTTACAA (by-product), TTTTTTTACAAT-3'PO4 (by-product) |

TABLE 68.3

| Reaction, quench, and analytical properties (condition 3, ATC, A) |
|---|
| Reaction conditions: Oligonucleotide - 2 µM TTTTTTTATC; Nucleotide triphosphate - 50 µM 3'PO4-dATP; Reaction buffer - 20 mM MOPS, pH 7.2, 0.002 Unit/µL *E. coli* pyrophosphatase (New England Biolabs), 50 mM potassium acetate, 250 µM cobalt (II) chloride; Reaction volume - 20 µL; TdT concentration - 2 µM; Reaction temperature - 50° C.; Reaction time - 10 minutes |
| Quench conditions: Quench solution and volume - Reactions were quenched by the addition of 30 µL methanol and 5 µL of 100 mM aqueous EDTA. After centrifugation at 4,000 rpm for 10 min at 4° C., 32 µL of the supernatant transferred to a new plate and further diluted by the addition of 18 µL water.; Plate type and seal - 96-well BioRad PCR plate with a plastic seal |
| Analytical conditions: Instrument - Agilent UHPLC 1260 prime series, Agilent Ultivo - see Example 4; Reaction product and by-products detected - TTTTTTTATC (substrate), TTTTTTTATCA-3'PO4 (product), TTTTTTTAT (by-product), TTTTTTTATCC (by-product), TTTTTTT ATCCA-3'PO4 (by-product) |

TABLE 68.4

| Reaction, quench, and analytical properties (condition 4 ATC, T) |
|---|
| Reaction conditions: Oligonucleotide - 2 µM TTTTTTTATC; Nucleotide triphosphate - 50 µM 3'PO4-dTTP; Reaction buffer - 20 mM MOPS, pH 7.2, 0.002 Unit/µL *E. coli* pyrophosphatase (New England Biolabs), 50 mM potassium acetate, 250 µM cobalt (II) chloride; Reaction volume - 20 µL; TdT concentration - 2 µM; Reaction temperature - 50° C.; Reaction time - 10 minutes |
| Quench conditions: Quench solution and volume - Reactions were quenched by the addition of 30 µL methanol and 5 µL of 100 mM aqueous EDTA. After centrifugation at 4,000 rpm for 10 min at 4° C., 32 µL of the supernatant transferred to a new plate and further diluted by the addition of 18 µL water.; Plate type and seal - 96-well BioRad PCR plate with a plastic seal |
| Analytical conditions: Instrument - Agilent UHPLC 1260 prime series, Agilent Ultivo - see Example 4; Reaction product and by-products detected - TTTTTTTATC (substrate), TTTTTTTATCT-3'PO4 (product), TTTTTTTAT (by-product), TTTTTTTATCC (by-product), TTTTTTTATCCT-3'PO4 (by-product) |

Percent product and by-product were calculated as the peak area of product or summed peak areas of by-products divided by the summed area of all analytes multiplied by 100. The ratio of the percent product to percent by-products was calculated for each variant and compared with the equivalent product/by-product ratio observed for SEQ ID NO: 1700 (where fold-improvement-over-parent or FIOP is equal to the product/by-product ratio of the variant divided by the product/by-product ratio of SEQ ID NO: 1700). The results are shown in Table 68.5-68.8.

TABLE 68.5

(condition 1, ACA, A)

| SEQ ID NO: (nt/aa) | Amino Acid Differences (Relative to SEQ ID NO: 1700) | FIOP % Product/ % By-Product Relative to SEQ ID NO: 1700 |
|---|---|---|
| 1881/1882 | K338G | ++ |

Levels of increased product/by-product ratio were determined relative to the reference polypeptide of SEQ ID NO: 4 and defined as follows: "+" 1.60 to 3.00, "++" >3.00, "+++" >5.00

TABLE 68.6

| (condition 2, ACA, T) | | |
|---|---|---|
| SEQ ID NO: (nt/aa) | Amino Acid Differences (Relative to SEQ ID NO: 1700) | FIOP % Product/ % By-Product Relative to SEQ ID NO: 1700 |
| 1881/1882 | K338G | +++ |

Levels of increased product/by-product ratio were determined relative to the reference polypeptide of SEQ ID NO: 4 and defined as follows: "+" 1.60 to 3.00, "++" >3.00, "+++" >5.00

TABLE 68.7

| (condition 3, ATC, A) | | |
|---|---|---|
| SEQ ID NO: (nt/aa) | Amino Acid Differences (Relative to SEQ ID NO: 1700) | FIOP % Product/ % By-Product Relative to SEQ ID NO: 1700 |
| 1881/1882 | K338G | +++ |

Levels of increased product/by-product ratio were determined relative to the reference polypeptide of SEQ ID NO: 4 and defined as follows: "+" 1.60 to 3.00, "++" >3.00, "+++" >5.00

TABLE 68.8

| (condition 4, ATC, T) | | |
|---|---|---|
| SEQ ID NO: (nt/aa) | Amino Acid Differences (Relative to SEQ ID NO: 1700) | FIOP % Product/ % By-Product Relative to SEQ ID NO: 1700 |
| 1881/1882 | K338G | + |

Levels of increased product/by-product ratio were determined relative to the reference polypeptide of SEQ ID NO: 4 and defined as follows: "+" 1.60 to 3.00, "++" >3.00, "+++" >5.00

Example 69

Stability of a 3'-Phosphorylated Oligonucleotide in the Lysates of *E. coli* Phosphatase (aphA, surE, cpdB) Knock-Out Strains Screening for the Stability of a 3'-phosphorylated Oligonucleotide Standard in Lysates

*E. coli* strains bearing single-gene deletions of aphA, surE, and cpdB (source: *E. coli* Keio Knockout collection) were cultured in shake flask and lysed as described in Example 3 with the following changes: the shake flask cultures were grown in media with 10 μg/ml kanamycin and no chloramphenicol and the mechanically lysed lysates were not purified further but were treated as described in Table 69.1.

Reactions were performed in 96-well format 200 μL BioRad PCR plates. Reactions included 2.7 μM 3'-phosphorylated oligonucleotide, *E. coli* lysate, 0.002 Unit/μL yeast pyrophosphatase (Thermo Scientific), 20 mM Tris-acetate, 50 mM potassium acetate, and 250 μM cobalt (II) chloride. The reactions were set up as follows: (i) all reaction components, except for lysate, were pre-mixed in a single solution, and 15 μL of this solution was aliquoted into each well of the 96-well plates (ii) 5 μL of heat-treated and clarified *E. coli* lysate was then added into the wells. The reaction plate was heat-sealed with a peelable aluminum seal and incubated in a thermocycler at the indicated temperature and reaction time, then held at 4° C. until the reaction was quenched. Reaction and quench details are specified in Table 69.1. Supernatant was then transferred into new HTP plates for analytical analysis as described in Table 69.1.

TABLE 69.1

| All lysis, purification, reaction, quench, and analytical properties |
|---|
| Lysis and purification conditions : Lysis buffer - 20 mM triethanolamine, pH 7.5; Lysis buffer volume - 35 mL; Lysate pre-treatment - Lysates were pre-incubated at 75° C. for 60 min, then centrifuged at 4,000 rpm for 10 min. The clarified supernatants were used in reactions.<br>Reaction conditions: Oligonucleotide - 2.7 μM TAATCA-3'PO4; Nucleotide triphosphate - none; Reaction buffer - 20 mM Tris-Acetate, pH 8.0, 0.002 Unit/μL yeast pyrophosphatase (Thermo Scientific), 50 mM potassium acetate, 250 μM cobalt (II) chloride; Reaction volume - 20 μL; Lysate dilution - l0x dilution prior to adding to the reaction; Reaction temperature - 40° C.; Reaction time - 2.5 hours<br>Quench conditions: Quench solution and volume - Reactions were quenched by the addition of 24 μL acetonitrile. The solutions were mixed well and then further diluted by the addition of 16 μL of 20 mM aqueous EDTA.; Plate type and seal - 96-well BioRad PCR plate with a plastic seal<br>Analytical conditions: Instrument - Agilent UHPLC 1260 prime series, Agilent Ultivo - see Example 4; Reaction product detected - TAATCA-3'PO4 (oligo product standard), TAATCA (dephosphorylated oligo) |

The ratio of the detected oligo product standard to dephosphorylated oligo was calculated as the ratio of the corresponding measured peak areas. The results are shown in Table 69.2 (where a "Peak Area Oligo Standard/Peak Area Dephosphorylated Oligo" of less than one would correspond to the condition resulting in more dephosphorylated oligo than phosphorylated oligo).

TABLE 69.2

| Single Gene Deletion vs. Parental *E. Coli* Strain | Peak Area Oligo Standard/ Peak Area Dephosphorylated Oligo |
|---|---|
| ΔaphA | +++ |
| ΔsurE | + |
| ΔcpdB | + |

Levels of increased activity were determined relative to the reference polypeptide of SEQ ID NO: 4 and defined as follows: "+" 0.45 to 1.00, "++" >1.00, "+++" >50.00

Example 70

Reduction of by-Products in TdT Reactions Run in the Lysate of *E. coli* Acid Phosphatase Knockout Screening for Improved by-Product Profiles of Reactions Run in Lysate Plasmid encoding TdT SEQ ID NO: 908 was isolated from the strain described in Example 17 using standard molecular biology techniques. An *E. coli* strain bearing a single-gene deletion of aphA (source: *E. coli* Keio Knockout collection) and a wild-type *E. coli* W3110 were transformed with the plasmid. These cultures were grown in shake flask and lysed as described in Example 3 with the following change: the mechanically lysed lysates were not purified further but were treated as described in Table 70.1. Additionally, TdT SEQ ID NO: 908 was grown, lysed, and purified in shake flask as described in Example 3. Reactions were run with the heat-treated and clarified WT or ΔaphA lysates supplemented with purified TdT SEQ ID NO: 908 as described below. Product and by-product formed by TdT SEQ ID NO: 908 in the presence of the WT or ΔaphA lysates were monitored to determine how the lysates affected by-product formation in the reactions.

Reactions were performed in 96-well format 200 μL BioRad PCR plates. Reactions included 4 μM oligonucleotide, 50 μM nucleotide triphosphate, *E. coli* lysate, TdT solution, 0.002 Unit/μL yeast pyrophosphatase (Thermo Scientific), 20 mM Tris-acetate, 50 mM potassium acetate, and 250 μM cobalt (II) chloride. The reactions were set up as follows: (i) all reaction components, except for TdT and lysate solutions, were pre-mixed in a single solution, and 10 μL of this solution was aliquoted into each well of the 96-well plates; (ii) 5 μL of heat-treated and clarified *E. coli* lysate was then added into the wells; (iii) 5 μL of TdT SEQ ID NO: 908 solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 70.1. Supernatant was then transferred into new HTP plates for analytical analysis as described in Table 70.1.

TABLE 70.1

| All lysis, purification, reaction, quench, and analytical properties |
|---|
| Lysis and purification conditions : Lysis buffer - 20 mM triethanolamine, pH 7.5; Lysis buffer volume - 35 mL; Lysate pre-treatment - Lysates were pre-incubated at 75° C. for 60 min, then centrifuged at 4,000 rpm for 10 min. The clarified supernatants were used in reactions. |
| Reaction conditions: Oligonucleotide - 4 μM TTTTTTTATC; Nucleotide triphosphate - 50 μM 3'PO4-dCTP; Reaction buffer - 20 mM Tris-Acetate, pH 8.0, 0.002 Unit/μL yeast pyrophosphatase (Thermo Scientific), 50 mM potassium acetate, 250 μM cobalt (II) chloride; Reaction volume - 20 μL; Lysate dilution - l0x dilution prior to adding to the reaction; TdT concentration - 11 μM; Reaction temperature - 40° C.; Reaction time - 15 minutes |
| Quench conditions: Quench solution and volume - Reactions were quenched by the addition of 24 μL acetonitrile. The solutions were mixed well and then further diluted by the addition of 16 μL of 20 mM aqueous EDTA.; Plate type and seal - 96-well BioRad PCR plate with a plastic seal |
| Analytical conditions: Instrument - Agilent UHPLC 1260 prime series, Agilent Ultivo - see Example 4; Reaction product and by-products detected - TTTTTTTATC (substrate), TTTTTTTATCC-3'PO4 (product), TTTTTTTATCC (by-product), TTTTTTTATCCC (by-product), TTTTTTTATCCC-3'PO4 (by-product), |

Percent product and by-product were calculated as the peak area of product or summed peak areas of by-products divided by the summed area of all analytes multiplied by 100. The ratio of the percent product to percent by-products was determined for each reaction condition. The results are shown in Table 70.2.

TABLE 70.2

| Single Gene Deletion vs. Parental *E. Coli* Strain | % Product/% By-Product |
|---|---|
| ΔaphA | +++ |
| Wild-type *E.coli* W3110 | + |

Levels of increased activity were determined relative to the reference polypeptide of SEQ ID NO: 4 and defined as follows: "+" 0.50 to 1.00, "++" >1.00, "+++" >3.00

Example 71

Improvements of Purified TdT Variants Over SEQ ID NO: 4 in the Extension of Oligonucleotide Acceptor Molecules with 3'-Phosphorylated Nucleotide Triphosphate Donors Screening Shake-Flask Purified TdT Variants for Improved Incorporation of 3'Phosphorylated Nucleotides Seven evolved TdT variants were selected from the first the first twenty rounds of evolution for shake-flask purification and screening for improved activity with 3'-phosphorylated nucleotides at two reaction temperatures, 45° C. or 61° C. Shake flasks were grown, lysed, and purified as described in Example 3.

Reactions were performed in 96-well format 200 μL BioRad PCR plates. Reactions included 2 μM oligonucleotide, 50 μM nucleotide triphosphate, TdT solution, 0.002 Unit/μL *E. coli* pyrophosphatase (New England Biolabs), 20 mM MOPS, 50 mM potassium acetate, and 250 μM cobalt (11) chloride. The reactions were set up as follows: (i) all reaction components, except for TdT, were pre-mixed in a single solution, and 15 μL of this solution was aliquoted into each well of the 96-well plates (ii) 5 μL of TdT solution (4× concentration in 20 mM MOPS, pH 7.2) was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 71.1. Supernatant was then transferred into new HTP plates for analytical analysis as described in Table 71.2.

TABLE 71.1

| Reaction, quench, and analytical properties (condition 1, ATC, C) |
|---|
| Reaction conditions: Oligonucleotide - 2 μM TTTTTTTATC; Nucleotide triphosphate - 50 μM 3'PO4-dCTP; Reaction buffer - 20 mM MOPS, pH 7.2, 0.002 Unit/μL *E. coli* pyrophosphatase (New England Biolabs), 50 mM potassium acetate, 250 μM cobalt (II) chloride; Reaction volume - 20 μL; TdT concentration - 1 μM; Reaction temperature - 45° C. or 61° C.; Reaction time - 1.5 minutes |
| Quench conditions: Quench solution and volume - Reactions were quenched by the addition of 30 μL methanol and 5 μL of 100 mM aqueous EDTA. After centrifugation at 4,000 rpm for 10 min at 4° C., 32 μL of the supernatant transferred to a new plate and further diluted by the addition of 18 μL water.; Plate type and seal - 96-well BioRad PCR plate with a plastic seal |
| Analytical conditions: Instrument - Agilent UHPLC 1260 prime series, Agilent Ultivo - see Example 4; Reaction product and by-products detected - TTTTTTTATC (substrate) , TTTTTTTATC-3'PO4 (by-product), TTTTTTTATCC (by-product), TTTTTTTATCC-3'PO4 (product), TTTTTTTATCCC-3'PO4 (by-product) |

TABLE 71.2

| Reaction, quench, and analytical properties (condition 2, ACA, T) |
|---|
| Reaction conditions: Oligonucleotide - 2 μM TTTTTTTACA; Nucleotide triphosphate - 50 μM 3'PO4-dTTP; Reaction buffer - 20 mM MOPS, pH 7.2, 0.002 Unit/μL *E. coli* pyrophosphatase (New England Biolabs), 50 mM potassium acetate, 250 μM cobalt (II) chloride; Reaction volume - 20 μL; TdT concentration - 1 μM; Reaction temperature - 45° C. or 61° C.; Reaction time - 1.5 minutes |
| Quench conditions: Quench solution and volume - Reactions were quenched by the addition of 30 μL methanol and 5 μL of 100 mM aqueous EDTA. After centrifugation at 4,000 rpm for 10 min at 4° C., 32 μL of the supernatant transferred to a new plate and further diluted by the addition of 18 μL water.; Plate type and seal - 96-well BioRad PCR plate with a plastic seal |
| Analytical conditions: Instrument - Agilent UHPLC 1260 prime series, Agilent Ultivo - see Example 4; Reaction product and by-products detected - TTTTTTTACA (substrate), TTTTTTTACT-3'PO4 (by-product), TTTTTTTACAA (by-product), TTTTTTTACAT-3'PO4 (product), TTTTTTTACAAT-3'PO4 (by-product) |

TABLE 71.3

| Reaction, quench, and analytical properties (condition 3, CGG, G) |
|---|
| Reaction conditions: Oligonucleotide - 2 μM TTTTTTTCGG; Nucleotide triphosphate - 50 μM 3'PO4-dGTP; Reaction buffer - 20 mM MOPS, pH 7.2, 0.002 Unit/μL *E. coli* pyrophosphatase (New England Biolabs), 50 mM potassium acetate, 250 μM cobalt (II) chloride; Reaction volume - 20 μL; TdT concentration - 1 μM; Reaction temperature - 45° C. or 61° C.; Reaction time - 1.5 minutes |
| Quench conditions: Quench solution and volume - Reactions were quenched by the addition of 30 μL methanol and 5 μL of 100 mM aqueous EDTA. After centrifugation at 4,000 rpm for 10 min at 4° C., 32 μL of the supernatant transferred to a new plate and further diluted by the addition of 18 μL water.; Plate type and seal - 96-well BioRad PCR plate with a plastic seal |
| Analytical conditions: Instrument - Agilent UHPLC 1260 prime series, Agilent Ultivo - see Example 4; Reaction product and by-products detected - TTTTTTTCGG (substrate), TTTTTTTCGG-3'PO4 (by-product), TTTTTTTCGGG (by-product), TTTTTTTCGGG-3'PO4(product), TTTTTTTCGGGG (by-product), TTTTTTTCGGGG-3'PO4 (by-product) |

Percent product calculated as the peak area of product divided by the summed area of all analytes multiplied by 100. The results are shown in Table 71.4-71.9.

TABLE 71.4

| (condition 1 ATC, C, 45C) | | |
|---|---|---|
| SEQ ID NO: (nt/aa) | Amino Acid Differences (Relative to SEQ ID NO: 4) | FIOP Product Peak Area Relative to SEQ ID NO: 4 |
| 881/882 | L20G/E21G/E60K/L72K/D160S/V180A/S200R/L246G/I259K/R338K/N358R | + |
| 1269/1270 | L20G/F52L/E60K/F67A/L72K/R87S/L157A/D160S/V180A/S200R/K219P/I259K/R338K/S349E/H350E | + |
| 1345/1346 | L20G/F52L/E60K/E65L/F67A/F71A/L72K/L77I/R87S/L157A/D160S/V180A/S200R/K219P/I259K/R338K/S349E/H350E/K353G | ++ |
| 1699/1700 | L20G/F52L/E60K/E65L/F67A/F71A/L72K/L77I/R87S/L157A/D160S/V180A/C182R/A186E/S200R/K219P/C256E/I259K/R338K/G341R/S349E/H350E/K353G/G360A | +++ |
| 2665/2666 | L20G/K29P/S34A/F52L/E60K/E65L/F67A/F71A/L72K/L77I/L78F/P84E/R87S/G98T/S143A/F147Y/L157A/ | +++ |

TABLE 71.4-continued

| (condition 1 ATC, C, 45C) | | |
|---|---|---|
| SEQ ID NO: (nt/aa) | Amino Acid Differences (Relative to SEQ ID NO: 4) | FIOP Product Peak Area Relative to SEQ ID NO: 4 |
| | D160S/V180A/C182M/A186E/S200R/K219P/I224V/P233R/C256E/I259K/E266G/R271H/S297A/Y298V/N299G/R338K/E339Q/G341R/S349E/H350E/K353G/G360A/R364L | |
| 2977/2978 | L20K/K29P/S34A/F52L/E60K/E65L/F67A/F71A/L72K/L77I/L78F/Y80S/P84E/R87S/G98T/V120I/F147Y/L157A/D160S/V180A/C182M/A186E/N197E/S200R/L203V/T211A/K219P/I224V/P233R/C256E/I259K/E266G/R271H/G292K/S297A/Y298V/N299G/R338G/E339Q/G341R/S349E/H350E/K353G/G360A/R364L | +++ |
| 3301/3302 | L20K/K29P/S34A/F52L/E60K/E65L/I66Q/F67A/F71A/L72K/L77I/L78F/Y80S/P84E/R87S/G98T/Q100D/V120I/F147Y/L157A/D160S/V180A/C182M/A186E/N197E/S200R/F202V/L203V/T211A/K219P/I224V/P233R/C256E/I259K/E266G/R271H/G292K/S297A/Y298V/N299G/I315V/Y327F/R338G/E339Q/G341R/S349E/H350E/K353D/I355L/G360R/R364L/R367G/K371S | +++ |

Levels of increased activity were determined relative to the reference polypeptide of SEQ ID NO: 4 and defined as follows: "+" 70 to 200, "++" >200, "+++" >500

TABLE 71.5

| (condition 1, ATC, C, 61C) | | |
|---|---|---|
| SEQ ID NO: (nt/aa) | Amino Acid Differences (Relative to SEQ ID NO: 4) | FIOP Product Peak Area Relative to SEQ ID NO: 4 |
| 881/882 | L20G/E21G/E60K/L72K/D160S/V180A/S200R/L246G/I259K/R338K/N358R | + |
| 1269/1270 | L20G/F52L/E60K/F67A/L72K/R87S/L157A/D160S/V180A/S200R/K219P/I259K/R338K/S349E/H350E | + |
| 1345/1346 | L20G/F52L/E60K/E65L/F67A/F71A/L72K/L77I/R87S/L157A/D160S/V180A/S200R/K219P/I259K/R338K/S349E/H350E/K353G | ++ |
| 1699/1700 | L20G/F52L/E60K/E65L/F67A/F71A/L72K/L77I/R87S/L157A/D160S/V180A/C182R/A186E/S200R/K219P/C256E/I259K/R338K/G341R/S349E/H350E/K353G/G360A | +++ |
| 2665/2666 | L20G/K29P/S34A/F52L/E60K/E65L/F67A/F71A/L72K/L77I/L78F/P84E/R87S/G98T/S143A/F147Y/L157A/D160S/V180A/C182M/A186E/S200R/K219P/I224V/P233R/C256E/I259K/E266G/R271H/S297A/Y298V/N299G/R338K/E339Q/G341R/S349E/H350E/K353G/G360A/R364L | +++ |
| 2977/2978 | L20K/K29P/S34A/F52L/E60K/E65L/F67A/F71A/L72K/L77I/L78F/Y80S/P84E/R87S/G98T/V120I/F147Y/L157A/D160S/V180A/C182M/A186E/N197E/S200R/L203V/T211A/K219P/I224V/P233R/C256E/I259K/E266G/R271H/G292K/S297A/Y298V/N299G/R338G/E339Q/G341R/S349E/H350E/K353G/G360A/R364L | +++ |
| 3301/3302 | L20K/K29P/S34A/F52L/E60K/E65L/I66Q/F67A/F71A/L72K/L77I/L78F/Y80S/P84E/R87S/G98T/Q100D/V120I/F147Y/L157A/D160S/V180A/C182M/A186E/N197E/S200R/F202V/L203V/T211A/K219P/I224V/P233R/C256E/I259K/E266G/R271H/G292K/S297A/Y298V/N299G/I315V/Y327F/R338G/E339Q/G341R/S349E/H350E/K353D/I355L/G360R/R364L/R367G/K371S | +++ |

Levels of increased activity were determined relative to the reference polypeptide of SEQ ID NO: 4 and defined as follows: "+" 35 to 100, "++" >100, "+++" >500

TABLE 71.6

| (condition 2, ACA, T, 45C) | | |
|---|---|---|
| SEQ ID NO: (nt/aa) | Amino Acid Differences (Relative to SEQ ID NO: 4) | FIOP Product Peak Area Relative to SEQ ID NO: 4 |
| 881/882 | L20G/E21G/E60K/L72K/D160S/V180A/S200R/L246G/I259K/R338K/N358R | + |
| 1269/1270 | L20G/F52L/E60K/F67A/L72K/R87S/L157A/D160S/V180A/S200R/K219P/I259K/R338K/S349E/H350E | + |

TABLE 71.6-continued

| (condition 2, ACA, T, 45C) | | |
|---|---|---|
| SEQ ID NO: (nt/aa) | Amino Acid Differences (Relative to SEQ ID NO: 4) | FIOP Product Peak Area Relative to SEQ ID NO: 4 |
| 1345/1346 | L20G/F52L/E60K/E65L/F67A/F71A/L72K/L77I/R87S/L157A/D160S/V180A/S200R/K219P/I259K/R338K/S349E/H350E/K353G | + |
| 1699/1700 | L20G/F52L/E60K/E65L/F67A/F71A/L72K/L77I/R87S/L157A/D160S/V180A/C182R/A186E/S200R/K219P/C256E/I259K/R338K/G341R/S349E/H350E/K353G/G360A | + |
| 2665/2666 | L20G/K29P/S34A/F52L/E60K/E65L/F67A/F71A/L72K/L77I/L78F/P84E/R87S/G98T/S143A/F147Y/L157A/D160S/V180A/C182M/A186E/S200R/K219P/I224V/P233R/C256E/I259K/E266G/R271H/S297A/Y298V/N299G/R338K/E339Q/G341R/S349E/H350E/K353G/G360A/R364L | ++ |
| 2977/2978 | L20K/K29P/S34A/F52L/E60K/E65L/F67A/F71A/L72K/L77I/L78F/Y80S/P84E/R87S/G98T/V120I/F147Y/L157A/D160S/V180A/C182M/A186E/N197E/S200R/L203V/T211A/K219P/I224V/P233R/C256E/I259K/E266G/R271H/G292K/S297A/Y298V/N299G/R338G/E339Q/G341R/S349E/H350E/K353G/G360A/R364L | ++ |
| 3301/3302 | L20K/K29P/S34A/F52L/E60K/E65L/I66Q/F67A/F71A/L72K/L77I/L78F/Y80S/P84E/R87S/G98T/Q100D/V120I/F147Y/L157A/D160S/V180A/C182M/A186E/N197E/S200R/F202V/L203V/T211A/K219P/I224V/P233R/C256E/I259K/E266G/R271H/G292K/S297A/Y298V/N299G/I315V/Y327F/R338G/E339Q/G341R/S349E/H350E/K353D/I355L/G360R/R364L/R367G/K371S | +++ |

Levels of increased activity were determined relative to the reference polypeptide of SEQ ID NO: 4 and defined as follows: "+" 4 to 100, "++" >100, "+++" >500

TABLE 71.7

| (condition 2, ACA, T, 61C) | | |
|---|---|---|
| SEQ ID NO: (nt/aa) | Amino Acid Differences (Relative to SEQ ID NO: 4) | FIOP Product Peak Area Relative to SEQ ID NO: 4 |
| 881/882 | L20G/E21G/E60K/L72K/D160S/V180A/S200R/L246G/I259K/R338K/N358R | + |
| 1269/1270 | L20G/F52L/E60K/F67A/L72K/R87S/L157A/D160S/V180A/S200R/K219P/I259K/R338K/S349E/H350E | + |
| 1345/1346 | L20G/F52L/E60K/E65L/F67A/F71A/L72K/L77I/R87S/L157A/D160S/V180A/S200R/K219P/I259K/R338K/S349E/H350E/K353G | + |
| 1699/1700 | L20G/F52L/E60K/E65L/F67A/F71A/L72K/L77I/R87S/L157A/D160S/V180A/C182R/A186E/S200R/K219P/C256E/I259K/R338K/G341R/S349E/H350E/K353G/G360A | + |
| 2665/2666 | L20G/K29P/S34A/F52L/E60K/E65L/F67A/F71A/L72K/L77I/L78F/P84E/R87S/G98T/S143A/F147Y/L157A/D160S/V180A/C182M/A186E/S200R/K219P/I224V/P233R/C256E/I259K/E266G/R271H/S297A/Y298V/N299G/R338K/E339Q/G341R/S349E/H350E/K353G/G360A/R364L | ++ |
| 2977/2978 | L20K/K29P/S34A/F52L/E60K/E65L/F67A/F71A/L72K/L77I/L78F/Y80S/P84E/R87S/G98T/V120I/F147Y/L157A/D160S/V180A/C182M/A186E/N197E/S200R/L203V/T211A/K219P/I224V/P233R/C256E/I259K/E266G/R271H/G292K/S297A/Y298V/N299G/R338G/E339Q/G341R/S349E/H350E/K353G/G360A/R364L | +++ |
| 3301/3302 | L20K/K29P/S34A/F52L/E60K/E65L/I66Q/F67A/F71A/L72K/L77I/L78F/Y80S/P84E/R87S/G98T/Q100D/V120I/F147Y/L157A/D160S/V180A/C182M/A186E/N197E/S200R/F202V/L203V/T211A/K219P/I224V/P233R/C256E/I259K/E266G/R271H/G292K/S297A/Y298V/N299G/I315V/Y327F/R338G/E339Q/G341R/S349E/H350E/K353D/I355L/G360R/R364L/R367G/K371S | +++ |

Levels of increased activity were determined relative to the reference polypeptide of SEQ ID NO: 4 and defined as follows: "+" 4 to 100, "++" >100, "+++" >300

TABLE 71.8

| (condition 3, CGG, G, 45C) | | |
|---|---|---|
| SEQ ID NO: (nt/aa) | Amino Acid Differences (Relative to SEQ ID NO: 4) | FIOP Product Peak Area Relative to SEQ ID NO: 4 |
| 1269/1270 | L20G/F52L/E60K/F67A/L72K/R87S/L157A/D160S/V180A/S200R/K219P/I259K/R338K/S349E/H350E | + |
| 1345/1346 | L20G/F52L/E60K/E65L/F67A/F71A/L72K/L77I/R87S/L157A/D160S/V180A/S200R/K219P/I259K/R338K/S349E/H350E/K353G | + |
| 1699/1700 | L20G/F52L/E60K/E65L/F67A/F71A/L72K/L77I/R87S/L157A/D160S/V180A/C182R/A186E/S200R/K219P/C256E/I259K/R338K/G341R/S349E/H350E/K353G/G360A | ++ |
| 2665/2666 | L20G/K29P/S34A/F52L/E60K/E65L/F67A/F71A/L72K/L77I/L78F/P84E/R87S/G98T/S143A/F147Y/L157A/D160S/V180A/C182M/A186E/S200R/K219P/I224V/P233R/C256E/I259K/E266G/R271H/S297A/Y298V/N299G/R338K/E339Q/G341R/S349E/H350E/K353G/G360A/R364L | ++ |
| 2977/2978 | L20K/K29P/S34A/F52L/E60K/E65L/F67A/F71A/L72K/L77I/L78F/Y80S/P84E/R87S/G98T/V120I/F147Y/L157A/D160S/V180A/C182M/A186E/N197E/S200R/L203V/T211A/K219P/I224V/P233R/C256E/I259K/E266G/R271H/G292K/S297A/Y298V/N299G/R338G/E339Q/G341R/S349E/H350E/K353G/G360A/R364L | +++ |
| 3301/3302 | L20K/K29P/S34A/F52L/E60K/E65L/I66Q/F67A/F71A/L72K/L77I/L78F/Y80S/P84E/R87S/G98T/Q100D/V120I/F147Y/L157A/D160S/V180A/C182M/A186E/N197E/S200R/F202V/L203V/T211A/K219P/I224V/P233R/C256E/I259K/E266G/R271H/G292K/S297A/Y298V/N299G/I315V/Y327F/R338G/E339Q/G341R/S349E/H350E/K353D/I355L/G360R/R364L/R367G/K371S | +++ |

Levels of increased activity were determined relative to the reference polypeptide of SEQ ID NO: 4 and defined as follows: "+" 19 to 50, "++" >50, "+++" >100

TABLE 71.9

| (condition 3, CGG, G, 61C) | | |
|---|---|---|
| SEQ ID NO: (nt/aa) | Amino Acid Differences (Relative to SEQ ID NO: 4) | FIOP Product Peak Area Relative to SEQ ID NO: 4 |
| 881/882 | L20G/E21G/E60K/L72K/D160S/V180A/S200R/L246G/I259K/R338K/N358R | + |
| 1269/1270 | L20G/F52L/E60K/F67A/L72K/R87S/L157A/D160S/V180A/S200R/K219P/I259K/R338K/S349E/H350E | + |
| 1345/1346 | L20G/F52L/E60K/E65L/F67A/F71A/L72K/L77I/R87S/L157A/D160S/V180A/S200R/K219P/I259K/R338K/S349E/H350E/K353G | + |
| 1699/1700 | L20G/F52L/E60K/E65L/F67A/F71A/L72K/L77I/R87S/L157A/D160S/V180A/C182R/A186E/S200R/K219P/C256E/I259K/R338K/G341R/S349E/H350E/K353G/G360A | + |
| 2665/2666 | L20G/K29P/S34A/F52L/E60K/E65L/F67A/F71A/L72K/L77I/L78F/P84E/R87S/G98T/S143A/F147Y/L157A/D160S/V180A/C182M/A186E/S200R/K219P/I224V/P233R/C256E/I259K/E266G/R271H/S297A/Y298V/N299G/R338K/E339Q/G341R/S349E/H350E/K353G/G360A/R364L | ++ |
| 2977/2978 | L20K/K29P/S34A/F52L/E60K/E65L/F67A/F71A/L72K/L77I/L78F/Y80S/P84E/R87S/G98T/V120I/F147Y/L157A/D160S/V180A/C182M/A186E/N197E/S200R/L203V/T211A/K219P/I224V/P233R/C256E/I259K/E266G/R271H/G292K/S297A/Y298V/N299G/R338G/E339Q/G341R/S349E/H350E/K353G/G360A/R364L | ++ |
| 3301/3302 | L20K/K29P/S34A/F52L/E60K/E65L/I66Q/F67A/F71A/L72K/L77I/L78F/Y80S/P84E/R87S/G98T/Q100D/V120I/F147Y/L157A/D160S/V180A/C182M/A186E/N197E/S200R/F202V/L203V/T211A/K219P/I224V/P233R/C256E/I259K/E266G/R271H/G292K/S297A/Y298V/N299G/I315V/Y327F/R338G/E339Q/G341R/S349E/H350E/K353D/I355L/G360R/R364L/R367G/K371S | +++ |

Levels of increased activity were determined relative to the reference polypeptide of SEQ ID NO: 4 and defined as follows: "+" 2 to 20, "++" >20, "+++" >150

Example 72

Expression of Full Length and Truncated Wild-Type TdT Variants

The coding sequences of multiple wild-type (WT) terminal deoxynucleotidyl transferase (TdT) enzymes (a phylogenetic tree of these full-length TdTs in relation to SEQ ID NO:2 is shown in FIG. 1) were codon optimized for expression in *E. coli* and synthesized. The synthetic constructs were subcloned between the BglI cleavage sites in *E. coli* expression vector pCK100900i (See e.g., U.S. Pat. No. 7,629,157 and US Pat. Appln. Publn. 2016/0244787, both of which are hereby incorporated by reference). In some cases, the TdT enzymes were cloned with their full length coding sequencing and/or were cloned as truncations where the first amino acid after the N-terminal 6×His tag corresponded to residue 131 in SEQ ID NO:2 (a phylogenetic tree of these truncated variants in relation to SEQ ID NO:4 is shown in FIG. 2). The full length and truncated TdT constructs were transformed into an *E. coli* strain derived from W3110.

Cells transformed with the TdT expression constructs were grown at shake-flask scale, lysed, purified, and dialyzed into storage buffer (20 mM Tris-HCl, pH 7.4, 100 mM KCl, 0.1 mM EDTA, and 50% glycerol) as described in Example 3. After overnight dialysis, protein samples were removed and TdT concentrations were measured by absorption at 280 nm using a NanoDrop™ 1000 spectrophotometer. Soluble protein concentrations for the highest expressing full length and truncated TdT samples are summarized in Table 72.1 below.

TABLE 72.1

| SEQ ID NO: (nt/aa) | Source organism of TdT gene sequence | Soluble Enzyme Concentration After Purification [mg/mL] |
|---|---|---|
| 3/4 | *Empidonax traillii, truncated* | +++ |
| 3619/3620 | *Mus musculus*, truncated | +++ |
| 3645/3646 | *Geospiza fortis*, truncated | ++ |
| 3643/3644 | *Serinus canaria*, truncated | ++ |
| 3641/3642 | *Ficedula albicollis*, truncated | ++ |
| 3629/3630 | *Monodelphis domestica*, truncated | + |
| 3621/3622 | *Rattus norvegicus*, truncated | + |
| 3623/3624 | *Homo sapiens*, truncated | + |
| 3633/3634 | *Bos taurus*, truncated | + |
| 3603/3604 | *Monodelphis domestica* | + |
| 3597/3598 | *Homo sapiens* | + |
| 3609/3610 | *Bos taurus* | + |

Concentrations of soluble TdT proteins after shake flask expression and purification as per Example 3.
Enzyme concentrations are shown as follows: "+" 0.80 to 3.00, "++" >3.00, "+++" >6.00 [mg/mL]

Example 73

Increased Incorporation of 3'-Phosphorylated Nucleotide Triphosphate Donors by an Evolved TdT Variant with Poly(Ethylene Glycol) 3350 and Formamide Adjuvants Screening a Shake-Flask Purified TdT Variant for Incorporation of 3'-Phosphorylated Nucleotides with PEG 3350 and Formamide Adjuvants TdT variant SEQ ID NO: 3488 was produced in shake flask and purified as described in Example 3. Purified TdT enzyme was screened for improved activity with 3'-phosphorylated nucleotides and multiple oligonucleotide acceptors in the presence of PEG 3350 or formamide.

Reactions were performed in 96-well format 200 μL BioRad PCR plates. Reactions included 1 μM oligonucleotide, 25 μM nucleotide triphosphate, TdT solution, 0.002 Unit/μL *E. coli* pyrophosphatase (New England Biolabs), 20 mM MOPS, 50 mM potassium acetate, and 250 μM cobalt (II) chloride. The reactions were set up as follows: (i) all reaction components, except for TdT and adjuvant, were pre-mixed in a single solution, and 10 μL of this solution was aliquoted into each well of the 96-well plate; (ii) L of water or of 4× aqueous adjuvant solution was added; (iii) 5 μL of TdT solution (4× concentration in 20 mM MOPS, pH 7.2) was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 73.1. Supernatant was then transferred into new HTP plates for analytical analysis.

For analysis of the reaction samples, capillary electrophoresis was performed using an ABI 3500xl Genetic Analyzer (ThermoFisher). Quenched reactions were diluted 1:200 in nuclease free water, then diluted 1:10 in Hi-Di™ Formamide (ThermoFisher) containing an appropriate size standard (LIZ or Alexa633). The ABI3500xl was configured with POP6 polymer, 50 cm capillaries and a 45° C. oven temperature. Pre-run settings were 18 KV for 180 sec. Injection was 5 KV for 5 sec, and the run settings were 19.5 KV for 600 sec. Substrates and products were identified by their sizes relative to the sizing ladder, with substrate oligos peaks at 20 bp and 3'-phosphorylated single nucleotide extension products appearing in the region of ~16-17 bp.

TABLE 73.1

| Reaction, quench, and analytical properties |
|---|
| Reaction conditions:<br>Oligonucleotide-1 μM<br>5'-6-FAM-TTTTTTTTTTTTTTTTTATC<br>or<br>5'-6-FAM-FAM-TTTTTTTTTTTTTTTTTCTG<br>Or<br>5'-6-FAM-FAM-TTTTTTTTTTTTTTTTTGAA<br>Or<br>5'-6-FAM-FAM-TTTTTTTTTTTTTTTTTGTT;<br>Nucleotide triphosphate 25 μM 3'PO4-dGTP<br>or 3'PO4-dTTP;<br>Reaction buffer 20 mM MOPS, pH 7.2,<br>0.002 Unit/μL *E. coli* pyrophosphatase<br>(New England Biolabs), 50 mM potassium acetate,<br>250 μM cobalt (II) chloride;<br>Adjuvant concentration<br>(if present) 2.5, 5, 10% PEG 3350 or formamide;<br>Reaction volume 20 μL; TdT concentration 1 μM; |

TABLE 73.1-continued

Reaction, quench, and analytical properties

Reaction temperature 60° C.;
Reaction time 1.5 minutes

Quench conditions:
Quench solution and volume
Reactions were quenched by the addition of 60 μL
of 35 mM aqueous EDTA. After thorough mixing,
5 μL of the quenched reaction
solution was further
diluted in 995 μL of water, and 2 μL of this
solution was transferred to a new
plate containing 18 μL HI DI formamide
with sizing ladder
(as described in example 73).;
Plate type 96-well Micro Amp Optical PCR plate Analytical conditions:
Instrument ABI (Thermo) 3500XL
see details above;
Reaction products detected
Reaction 1:
5'-6-FAM-TTTTTTTTTTTTTTTTATC (substrate),
5'-6-FAM-TTTTTTTTTTTTTTTTATCG-3P04 (product),
Reaction 2:
5'-6-FAM-TTTTTTTTTTTTTTTTATC (substrate),
5'-6-FAM-TTTTTTTTTTTTTTTTATCT-3'PO4 (product),
Reaction 3:

TABLE 73.1-continued

Reaction, quench, and analytical properties

5'-6-FAM-TTTTTTTTTTTTTTTTTCTG (substrate),
5'-6-FAM-TTTTTTTTTTTTTTTTTCTGG-3P04 (product),
Reaction 4:
5'-6-FAM-TTTTTTTTTTTTTTTTTCTG (substrate),
5'-6-FAM-TTTTTTTTTTTTTTTTTCTGT-3'PO4 (product),
Reaction 5:
5'-6-FAM-TTTTTTTTTTTTTTTTTGAA (substrate),
5'-6-FAM-TTTTTTTTTTTTTTTTTGAAG3,pO4 (product).
Reaction 6:
5'-6-FAM-TTTTTTTTTTTTTTTTTGAA (substrate),
5'-6-FAM-TTTTTTTTTTTTTTTTTGAAT-3'PO4 (product),
Reaction 7:
5'-6-FAM-TTTTTTTTTTTTTTTTTGTT (substrate),
5'-6-FAM-TTTTTTTTTTTTTTTTTGTTG-3'PO4 (product),
Reaction 8:
5'-6-FAM-TTTTTTTTTTTTTTTTTGTT (substrate),
5'-6-FAM-TTTTTTTTTTTTTTTTTGTTT-3'PO4 (product)

Percent product calculated as the peak area of product divided by the summed area of all analytes multiplied by 100. Activity relative to control reactions without adjuvant was calculated as the ratio of the percent product in reactions with adjuvant to the percent product of the average of triplicate control reactions. The results are shown in Table 73.2.

TABLE 73.2

| Reaction | Reaction product | Adjuvant | % adjuvant (volume in reaction) | % product with adjuvant/ % product control |
|---|---|---|---|---|
| 1 | 5'-6-FAM-TTTTTTTTTTTTTTTTATCG-3'PO4 | formamide | 2.5 | + |
| 1 | 5'-6-FAM-TTTTTTTTTTTTTTTTATCG-3'PO4 | formamide | 5 | + |
| 1 | 5'-6-FAM-TTTTTTTTTTTTTTTTATCG-3'PO4 | formamide | 10 | + |
| 1 | 5'-6-FAM-TTTTTTTTTTTTTTTTATCG-3'PO4 | PEG 3350 | 2.5 | + |
| 1 | 5'-6-FAM-TTTTTTTTTTTTTTTTATCG-3'PO4 | PEG 3350 | 5 | ++ |
| 1 | 5'-6-FAM-TTTTTTTTTTTTTTTTATCG-3'PO4 | PEG 3350 | 10 | + |
| 2 | 5'-6-FAM-TTTTTTTTTTTTTTTTATCT-3'PO4 | formamide | 2.5 | ++ |
| 2 | 5'-6-FAM-TTTTTTTTTTTTTTTTATCT-3'PO4 | formamide | 5.0 | ++ |
| 2 | 5'-6-FAM-TTTTTTTTTTTTTTTTATCT-3'PO4 | formamide | 10.0 | ++ |
| 2 | 5'-6-FAM-TTTTTTTTTTTTTTTTATCT-3'PO4 | PEG 3350 | 2.5 | ++ |
| 2 | 5'-6-FAM-TTTTTTTTTTTTTTTTATCT-3'PO4 | PEG 3350 | 5.0 | ++ |
| 2 | 5'-6-FAM-TTTTTTTTTTTTTTTTATCT-3'PO4 | PEG 3350 | 10.0 | ++ |
| 3 | 5'-6-FAM-TTTTTTTTTTTTTTTTTCTGG-3'PO4 | formamide | 2.5 | +++ |
| 3 | 5'-6-FAM-TTTTTTTTTTTTTTTTTCTGG-3'PO4 | formamide | 5 | +++ |
| 3 | 5'-6-FAM-TTTTTTTTTTTTTTTTTCTGG-3'PO4 | formamide | 10 | +++ |
| 3 | 5'-6-FAM-TTTTTTTTTTTTTTTTTCTGG-3'PO4 | PEG 3350 | 2.5 | ++ |
| 3 | 5'-6-FAM-TTTTTTTTTTTTTTTTTCTGG-3'PO4 | PEG 3350 | 5 | ++ |
| 3 | 5'-6-FAM-TTTTTTTTTTTTTTTTTCTGG-3'PO4 | PEG 3350 | 10 | ++ |
| 4 | 5'-6-FAM-TTTTTTTTTTTTTTTTTCTGT-3'PO4 | formamide | 2.5 | +++ |
| 4 | 5'-6-FAM-TTTTTTTTTTTTTTTTTCTGT-3'PO4 | formamide | 5 | +++ |

TABLE 73.2-continued

| Reaction | Reaction product | Adjuvant | % adjuvant (volume in reaction) | % product with adjuvant/ % product control |
|---|---|---|---|---|
| 4 | 5'-6-FAM-TTTTTTTTTTTTTTTTTCTGT-3'PO4 | formamide | 10 | +++ |
| 4 | 5'-6-FAM-TTTTTTTTTTTTTTTTTCTGT-3'PO4 | PEG 3350 | 2.5 | ++ |
| 4 | 5'-6-FAM-TTTTTTTTTTTTTTTTTCTGT-3'PO4 | PEG 3350 | 5 | ++ |
| 4 | 5'-6-FAM-TTTTTTTTTTTTTTTTTCTGT-3'PO4 | PEG 3350 | 10 | ++ |
| 5 | 5'-6-FAM-TTTTTTTTTTTTTTTTTGAAG-3'PO4 | formamide | 2.5 | ++ |
| 5 | 5'-6-FAM-TTTTTTTTTTTTTTTTTGAAG-3'PO4 | formamide | 5 | ++ |
| 5 | 5'-6-FAM-TTTTTTTTTTTTTTTTTGAAG-3'PO4 | formamide | 10 | ++ |
| 5 | 5'-6-FAM-TTTTTTTTTTTTTTTTTGAAG-3'PO4 | PEG 3350 | 2.5 | ++ |
| 5 | 5'-6-FAM-TTTTTTTTTTTTTTTTTGAAG-3'PO4 | PEG 3350 | 5 | ++ |
| 5 | 5'-6-FAM-TTTTTTTTTTTTTTTTTGAAG-3'PO4 | PEG 3350 | 10 | ++ |
| 6 | 5'-6-FAM-TTTTTTTTTTTTTTTTTGAAT-3'PO4 | formamide | 2.5 | ++ |
| 6 | 5'-6-FAM-TTTTTTTTTTTTTTTTTGAAT-3'PO4 | formamide | 5.0 | ++ |
| 6 | 5'-6-FAM-TTTTTTTTTTTTTTTTTGAAT-3'PO4 | formamide | 10.0 | ++ |
| 6 | 5'-6-FAM-TTTTTTTTTTTTTTTTTGAAT-3'PO4 | PEG 3350 | 2.5 | ++ |
| 6 | 5'-6-FAM-TTTTTTTTTTTTTTTTTGAAT-3'PO4 | PEG 3350 | 5.0 | ++ |
| 6 | 5'-6-FAM-TTTTTTTTTTTTTTTTTGAAT-3'PO4 | PEG 3350 | 10.0 | ++ |
| 7 | 5'-6-FAM-TTTTTTTTTTTTTTTTTGTTG-3'PO4 | formamide | 2.5 | + |
| 7 | 5'-6-FAM-TTTTTTTTTTTTTTTTTGTTG-3'PO4 | formamide | 5 | + |
| 7 | 5'-6-FAM-TTTTTTTTTTTTTTTTTGTTG-3'PO4 | formamide | 10 | + |
| 7 | 5'-6-FAM-TTTTTTTTTTTTTTTTTGTTG-3'PO4 | PEG 3350 | 2.5 | + |
| 7 | 5'-6-FAM-TTTTTTTTTTTTTTTTTGTTG-3'PO4 | PEG 3350 | 5 | + |
| 7 | 5'-6-FAM-TTTTTTTTTTTTTTTTTGTTG-3'PO4 | PEG 3350 | 10 | + |
| 8 | 5'-6-FAM-TTTTTTTTTTTTTTTTTGTTT-3'PO4 | formamide | 2.5 | ++ |
| 8 | 5'-6-FAM-TTTTTTTTTTTTTTTTTGTTT-3'PO4 | formamide | 5 | ++ |
| 8 | 5'-6-FAM-TTTTTTTTTTTTTTTTTGTTT-3'PO4 | formamide | 10 | ++ |
| 8 | 5'-6-FAM-TTTTTTTTTTTTTTTTTGTTT-3'PO4 | PEG 3350 | 2.5 | ++ |
| 8 | 5'-6-FAM-TTTTTTTTTTTTTTTTTGTTT-3'PO4 | PEG 3350 | 5 | ++ |
| 8 | 5'-6-FAM-TTTTTTTTTTTTTTTTTGTTT-3'PO4 | PEG 3350 | 10 | ++ |

Levels of increased activity were determined relative to the control reaction and defined as follows: "+" 1.1 to 1.4, "++" > 1.5, "+++" > 3

Example 74

Improvements Over SEQ ID NO: 3074 in the Extension of Oligonucleotide Acceptor Molecules with Nucleotide Triphosphate Donors HTP Screening for Improved TdT Variants SEQ ID NO: 3074 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 74.1.

Reactions were performed in 96-well format 200 µL BioRad PCR plates. Reactions included 1-4 µM oligonucleotide, 5-50 µM nucleotide triphosphate, 0.002 Unit/µL yeast pyrophosphatase (Thermo Scientific), 20 mM buffer, 50 mM potassium acetate, and 250 µM cobalt (II) chloride. The reactions were set up as follows: (i) all reaction components, except for TdT, were pre-mixed in a single solution, and 15 µL of this solution was aliquoted into each well of the 96-well plates (ii) 5 µL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 74.1. The quenched reactions were centrifuged at 4,000 rpm for 10 min at 4° C. to pellet any precipitate. Supernatant was then transferred into new HTP plates for analytical analysis as described in Table 74.1.

TABLE 74.1

| All lysis, purification, reaction, quench, and analytical properties |
|---|
| Lysis and purification conditions : Lysis buffer - 20 mM Tris-acetate, pH 8, 0.2 g/L lysozyme from chicken egg white; Lysis buffer volume - 400 µL; Lysate pre-treatment - Lysates were preincubated at 60° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide - 4 µM TTTTTTTCGG; Nucleotide triphosphate - 50 µM 3'PO4-dGTP; Reaction buffer - 20 mM MOPS, pH 7.2, 0.002 Unit/µL yeast pyrophosphatase (Thermo Scientific), 50 mM potassium acetate, 250 µM cobalt (II) chloride; Reaction volume - 36 µL; Lysate dilution - 4x dilution prior to adding to the reaction; Reaction temperature - 60° C.; Reaction time - 15 minutes |
| Quench conditions: Quench solution and volume - Reactions were quenched by adding two volumes of 90% acetonitrile and 10% methanol mixture and clarifying by centrifugation; Plate type and seal - 384-well microtiter plate with seal |
| Analytical conditions: Instrument - Agilent RapidFire SPE-MS/MS - see Example 6; Reaction product detected - TTTTTTTCGGG-3'PO4 |

Activity relative to SEQ ID NO: 3074 (Activity FIOP) was calculated as the product peak area of the variant compared with the product peak area observed by the reaction with SEQ ID NO: 3074 (where the peak area may be set as the average of replicates or else the highest single sample as appropriate). The results are shown in Table 74.2.

TABLE 74.2

| SEQ ID NO: (nt/aa) | Amino Acid Differences (Relative to SEQ ID NO: 3074) | FIOP Product Peak Area Relative to SEQ ID NO: 3074 |
|---|---|---|
| 3697/3698 | F279H | +++ |
| 3699/3700 | I321M | +++ |
| 3701/3702 | A275E | +++ |
| 3703/3704 | A380G | +++ |
| 3705/3706 | I368Q | ++ |
| 3707/3708 | E238V | ++ |
| 3709/3710 | K234L | ++ |
| 3711/3712 | I273D | ++ |
| 3713/3714 | H271P | ++ |
| 3715/3716 | K234P | ++ |
| 3717/3718 | V203I | ++ |
| 3719/3720 | M235C | ++ |
| 3721/3722 | V203G | + |
| 3723/3724 | G373N | + |
| 3725/3726 | N230E | + |
| 3727/3728 | L344C | + |
| 3729/3730 | N16M | + |
| 3731/3732 | E349C | + |
| 3733/3734 | H271Q | + |
| 3735/3736 | K234A | + |
| 3737/3738 | K234Q | + |
| 3739/3740 | M235V | + |
| 3741/3742 | A380S | + |
| 3743/3744 | P231I | + |
| 3745/3746 | T201V | + |

Levels of increased activity were determined relative to the reference polypeptide of SEQ ID NO: 3398 and defined as follows: "+" 1.15 to 1.35, "++" >1.35, "+++" >1.82

Example 75

Improvements Over SEQ ID NO: 3488 in the Extension of Oligonucleotide Acceptor Molecules with Nucleotide Triphosphate Donors HTP Screening for Improved TdT Variants SEQ ID NO: 3488 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 75.1.

Reactions were performed in 96-well format 200 µL BioRad PCR plates. Reactions included 1-4 µM oligonucleotide, 5-50 µM nucleotide triphosphate, 0.002 Unit/µL yeast pyrophosphatase (Thermo Scientific), 20 mM buffer, 50 mM potassium acetate, and 250 µM cobalt (11) chloride. The reactions were set up as follows: (i) all reaction components, except for TdT, were pre-mixed in a single solution, and 15 µL of this solution was aliquoted into each well of the 96-well plates (ii) 5 µL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 75.1. The quenched reactions were centrifuged at 4,000 rpm for 10 min at 4° C. to pellet any precipitate. Supernatant was then transferred into new HTP plates for analytical analysis as described in Table 75.1.

TABLE 75.1

| All lysis, purification, reaction, quench, and analytical properties |
|---|
| Lysis and purification conditions : Lysis buffer - 20 mM Tris-acetate, pH 8, 0.2 g/L lysozyme from chicken egg white; Lysis buffer volume - 400 µL; Lysate pre-treatment - Lysates were preincubated at 63° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide - 4 µM TTTTTTTATC; Nucleotide triphosphate - 50 µM 3'PO4-dATP; Reaction buffer - 20 mM MOPS, pH 7.2, 0.002 Unit/µL yeast pyrophosphatase (Thermo Scientific), 50 mM potassium acetate, 250 µM cobalt (II) chloride; Reaction volume - 36 µL; Lysate dilution - 2x dilution prior to adding to the reaction; Reaction temperature - 63° C.; Reaction time - 15 minutes |
| Quench conditions: Quench solution and volume - Reactions were quenched by adding two volumes of 90% acetonitrile and 10% methanol mixture and clarifying by centrifugation; Plate type and seal - 384-well microtiter plate with seal |
| Analytical conditions: Instrument - Agilent RapidFire SPE-MS/MS - see Example 6; Reaction product detected - TTTTTTTATCA-3'PO4 |

Activity relative to SEQ ID NO: 3488 (Activity FIOP) was calculated as the product peak area of the variant compared with the product peak area observed by the reaction with SEQ ID NO: 3488 (where the peak area may be set as the average of replicates or else the highest single sample as appropriate). The results are shown in Table 75.2.

TABLE 75.2

| SEQ ID NO: (nt/aa) | Amino Acid Differences (Relative to SEQ ID NO: 3488) | FIOP Product Peak Area Relative to SEQ ID NO: 3488 |
|---|---|---|
| 3747/3748 | S15G/I77V/T201L/F226L/N230I/Q339I | +++ |
| 3749/3750 | Pl4E/S15G/I77V/R200A/F226L/N230P | +++ |
| 3751/3752 | S15G/F78L/V203S/F226L/N230I | +++ |
| 3753/3754 | F78L/F226L/N230P | +++ |
| 3755/3756 | P14E/S15G/I77V/F78L/R200A/V203S/N230I/Q290H | +++ |
| 3757/3758 | S15G/F78L/T201L/V203S/N230P | +++ |
| 3759/3760 | P14E/R200A/V203S/F226L/N230I | +++ |
| 3761/3762 | I77V/F78L/V203S/N230P/Q339I | +++ |
| 3763/3764 | P14E/F78L/R200A/F226L/N230P/Q339I | +++ |
| 3765/3766 | S15G/I77V/F78L | +++ |
| 3767/3768 | F78L/F226L/Q290R | +++ |
| 3769/3770 | P14E/T201L/V203S/F226L | +++ |
| 3771/3772 | F78L/F226L/N230I | +++ |
| 3773/3774 | P14E/I77V/F78L/R200A/F226L/N230P/D257T | +++ |
| 3775/3776 | P14E/S15G/R200A/N230I | +++ |
| 3777/3778 | F78L/R200A/N230P | +++ |
| 3779/3780 | I77V/R200A/T201L/F226L/N230P/Q339I | +++ |
| 3781/3782 | Pl4E/I77V/T201L/N230I | +++ |
| 3783/3784 | F78L/V203S/N230P/Q290R | +++ |
| 3785/3786 | Q32P/E235T/I273Q | +++ |
| 3787/3788 | P14E/S15G/I77V/F78L/V203S/F226L/N230I/Q290R | ++ |
| 3789/3790 | S15G/I77V/R200A/T201L/V203S/F226L/N230P/ Q290R/Q339I | ++ |
| 3791/3792 | S15G/F226L/N230I/Q339I | ++ |
| 3793/3794 | I77V/F78L/R200A/F226L/Q339I | ++ |
| 3795/3796 | P14E/S15G/I77V/F78L/R200A/T201L/F226L/ N230P/Q290R | ++ |
| 3797/3798 | P14E/F78L/R200A/N230I/Q339I | ++ |
| 3799/3800 | Q32P/L207E/E235T | ++ |
| 3801/3802 | I77V/R200A/N230P | ++ |
| 3803/3804 | S15G/I77V/R200A/N230P | ++ |
| 3805/3806 | S15G/I77V/F226L/N230P/Q290R/Q339I | ++ |
| 3807/3808 | P14E/S15G/I77V/F78L | ++ |
| 3809/3810 | S15G/N230P | ++ |
| 3811/3812 | R200A/V203S/F226L/N230P/Q339I | ++ |
| 3813/3814 | S15G/I77V/F78L/R200A/T201L/V203S/F226L/ N230P | ++ |
| 3815/3816 | P14E/R200A/V203S/N230P/Q339I | ++ |
| 3817/3818 | S15G/I77V/R200A/N230P/Q290R/Q339I | ++ |

TABLE 75.2-continued

| SEQ ID NO: (nt/aa) | Amino Acid Differences (Relative to SEQ ID NO: 3488) | FIOP Product Peak Area Relative to SEQ ID NO: 3488 |
|---|---|---|
| 3819/3820 | Q32P/I210L/G232I/E235T/I368Q | ++ |
| 3821/3822 | P14E/S15G/F78L | ++ |
| 3823/3824 | Q32P/D103P/E106R/L207E/I210L/E235T/I321M/I368Q | ++ |
| 3825/3826 | S15G/F78L/T201L/N230P/Q290R | ++ |
| 3827/3828 | P14E/F78L/R200A/T201L/F226L/Q290R | ++ |
| 3829/3830 | P14E/F78L/R200A/F226L/Q290R/Q339I | ++ |
| 3831/3832 | V203S/F226L/N230P | ++ |
| 3833/3834 | E106R/E235T/I273P/G373D | ++ |
| 3835/3836 | Q32P/I210L/I273P | ++ |
| 3837/3838 | L207E/E235T/I368Q | ++ |
| 3839/3840 | I77V/R200A/T201L | ++ |
| 3841/3842 | P14E/S15G/F78L/F226L/N230P | ++ |
| 3843/3844 | F78L | ++ |
| 3845/3846 | S15G/N230I | ++ |
| 3847/3848 | Q32P/D103P/I273P | + |
| 3849/3850 | G232N/E235T/I321M | + |
| 3851/3852 | D103P/G2321/I273Q | + |
| 3853/3854 | Q32P/E106R/L207E/I210L/G232I | + |
| 3855/3856 | P14E/I77V/F78L/F226L/N230P/D257T | + |
| 3857/3858 | L207E/E235T | + |
| 3859/3860 | E235T | + |
| 3861/3862 | Q32P/L207E/I210L/I368Q/G373D | + |
| 3863/3864 | Q32P/E106R/I273Q/I321M/G373D | + |
| 3865/3866 | S15G/F78L/T201L | + |
| 3867/3868 | P14E/R200A/V203S/F226L/N230P/D257T/Q339I | + |
| 3869/3870 | D103P/E106R/L207E/I321M | + |
| 3871/3872 | D103P/L207E/I210L/E235T/I321M | + |
| 3873/3874 | Q32P/L207E/I210L/I273Q | + |
| 3875/3876 | Q32P/E106R/E235T/I321M | + |
| 3877/3878 | S15G/T201L/V203S/F226L/N230P/D257T/Q339I | + |
| 3879/3880 | E235T/I273P | + |
| 3881/3882 | Q32P/E106R | + |
| 3883/3884 | L207E/G373D | + |
| 3885/3886 | D103P/E106R/I210L | + |
| 3887/3888 | I77V/R200A/V203S/N230P/D257T/Q339I | + |
| 3889/3890 | T201L/N230P/Q290R | + |
| 3891/3892 | Q32P/E106R/E235T/I368Q | + |
| 3893/3894 | S15G/I77V | + |
| 3895/3896 | V203S | + |
| 3897/3898 | Q32P/E106R/I210L | + |
| 3899/3900 | V203S/F226L/N230I/D257T | + |
| 3901/3902 | D103P/I210L/G232N/E235T | + |
| 3903/3904 | G2321/E235T/I321M | + |
| 3905/3906 | S15G/R200A | + |
| 3907/3908 | E106R/I273Q | + |
| 3909/3910 | Q32P/D103P/I210L/I273P/I321M/G373D | + |
| 3911/3912 | I77V/F78L/V203S | + |
| 3913/3914 | E106R/L207E/E235T/I321M/I368Q | + |
| 3915/3916 | Q32P/D103P | + |
| 3917/3918 | Q32P/E106R/I210L/G373D | + |
| 3919/3920 | E106R/L207E/I210L/G232I/E235T/I321M/I368Q/G373D | + |
| 3921/3922 | G232N/E235T | + |
| 3923/3924 | G232N/E235T/I273Q/I368Q | + |
| 3925/3926 | Q32P | + |
| 3927/3928 | I273P | + |
| 3929/3930 | I77V/F78L/T201L/F226L/D257T/Q339I | + |
| 3931/3932 | R200A/N230I/D257T | + |
| 3933/3934 | Q32P/D103P/L207E/I228V/G232I/G373D | + |
| 3935/3936 | T201L/N230P/D257T | + |
| 3937/3938 | L207E/I368Q/G373D | + |
| 3939/3940 | T201L/V203S | + |
| 3941/3942 | P14E/F78L/R200A/T201L/Q339I | + |
| 3943/3944 | T201L | + |
| 3945/3946 | E106R | + |
| 3947/3948 | R200A | + |

Levels of increased activity were determined relative to the reference polypeptide of SEQ ID NO: 3488 and defined as follows: "+" 1.24 to 1.75, "++" >1.75, "+++" >2.10

Example 76

Improvements Over SEQ ID NO: 3488 in the Extension of Oligonucleotide Acceptor Molecules with Nucleotide Triphosphate Donors HTP Screening for Improved TdT Variants SEQ ID NO: 3488 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 76.1.

Reactions were performed in 96-well format 200 μL BioRad PCR plates. Reactions included 1-4 μM oligonucleotide, 5-50 μM nucleotide triphosphate, 0.002 Unit/μL yeast pyrophosphatase (Thermo Scientific), 20 mM buffer, 50 mM potassium acetate, and 250 μM cobalt (11) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 76.1. The quenched reactions were centrifuged at 4,000 rpm for 10 min at 4° C. to pellet any precipitate. Supernatant was then transferred into new HTP plates for analytical analysis as described in Table 76.1.

TABLE 76.1

| All lysis, purification, reaction, quench, and analytical properties |
|---|
| Lysis and purification conditions : Lysis buffer - 20 mM Tris-acetate, pH 8, 0.2 g/L lysozyme from chicken egg white; Lysis buffer volume - 400 μL; Lysate pre-treatment - Lysates were preincubated at 60° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide - 4 μM TTTTTTTCGA; Nucleotide triphosphate - 50 μM 3'PO4-dTTP; Reaction buffer - 20 mM MOPS, pH 7.2, 0.002 Unit/μL yeast pyrophosphatase (Thermo Scientific), 50 mM potassium acetate, 250 μM cobalt (II) chloride; Reaction volume - 36 μL; Lysate dilution - 4x dilution prior to adding to the reaction; Reaction temperature - 60° C.; Reaction time - 15 minutes |
| Quench conditions: Quench solution and volume - Reactions were quenched by adding two volumes of 90% acetonitrile and 10% methanol mixture and clarifying by centrifugation; Plate type and seal - 384-well microtiter plate with seal |
| Analytical conditions: Instrument - Agilent RapidFire SPE-MS/MS - see Example 6; Reaction product detected - TTTTTTTCGAT-3'PO4 |

Activity relative to SEQ ID NO: 3488 (Activity FIOP) was calculated as the product peak area of the variant compared with the product peak area observed by the reaction with SEQ ID NO: 3488 (where the peak area may be set as the average of replicates or else the highest single sample as appropriate). The results are shown in Table 76.2.

TABLE 76.2

| SEQID NO: (nt/aa) | Amino Acid Differences (Relative to SEQ ID NO: 3488) | FIOP Product Peak Area Relative to SEQ ID NO: 3488 |
|---|---|---|
| 3795/3796 | P14E/S15G/I77 V/F78L/R200A/T201L/F226L/N230P/Q290R | +++ |
| 3787/3788 | P14E/S15G/I77V/F78L/V203S/F226L/N230I/Q290R | +++ |
| 3755/3756 | P14E/S15G/I77V/F78L/R200A/V203S/N230I/Q290H | +++ |
| 3759/3760 | P14E/R200A/V203S/F226L/N230I | +++ |
| 3909/3910 | Q32P/D103P/I210L/I273P/I321M/G373D | +++ |
| 3773/3774 | P14E/I77V/F78L/R200A/F226L/N230P/D257T | +++ |
| 3823/3824 | Q32P/D103P/E106R/L207E/I210L/E235T/I321M/I368Q | +++ |
| 3831/3832 | V203S/F226L/N230P | +++ |
| 3757/3758 | S15G/F78L/T201L/V203S/N230P | +++ |
| 3775/3776 | P14E/S15G/R200A/N230I | +++ |
| 3885/3886 | D103P/E106R/I210L | ++ |
| 3751/3752 | S15G/F78LV203S/F226L/N230I | ++ |
| 3861/3862 | Q32P/L207E/I210L/I368Q/G373D | ++ |
| 3879/3880 | E235T/I273P | ++ |
| 3901/3902 | D103P/I210L/G232N/E235T | ++ |
| 3845/3846 | S15G/N230I | ++ |
| 3769/3770 | P14E/T201L/V203S/F226L | ++ |
| 3799/3800 | Q32P/L207E/E235T | ++ |
| 3939/3940 | T201L/V203S | ++ |
| 3913/3914 | E106R/L207E/E235T/I321M/I368Q | ++ |
| 3833/3834 | E106R/E235T/I273P/G373D | ++ |
| 3763/3764 | P14E/F78L/R200A/F226L/N230P/Q339I | ++ |
| 3813/3814 | S15G/I77V/F78L/R200A/T201L/V203S/F226L/N230P | ++ |
| 3749/3750 | P14E/S15G/I77V/R200A/F226L/N230P | ++ |
| 3949/3950 | Q32P/I210L/G232I/I273P/I321M | ++ |

TABLE 76.2-continued

| SEQID NO: (nt/aa) | Amino Acid Differences (Relative to SEQ ID NO: 3488) | FIOP Product Peak Area Relative to SEQ ID NO: 3488 |
|---|---|---|
| 3783/3784 | F78L/V203S/N230P/Q290R | + |
| 3951/3952 | Q32P/I210L/I273P | ++ |
| 3847/3848 | Q32P/D103P/I273P | + |
| 3837/3838 | L207E/E235T/I368Q | + |
| 3753/3754 | F78L/F226L/N230P | + |
| 3803/3804 | S15G/I77V/R200A/N230P | + |
| 3849/3850 | G232N/E235T/I321M | + |
| 3841/3842 | P14E/S15G/F78L/F226L/N230P | + |
| 3801/3802 | I77V/R200A/N230P | + |
| 3747/3748 | S15G/I77V/T201L/F226L/N230I/Q339I | + |
| 3871/3872 | D103P/L207E/I210L/E235T/I321M | + |
| 3869/3870 | D103P/E106R/L207E/I321M | + |
| 3891/3892 | Q32P/E106R/E235T/I368Q | + |
| 3851/3852 | D103P/G232I/I273Q | + |
| 3859/3860 | E235T | + |
| 3853/3854 | Q32P/E106R/L207E/I210L/G232I | + |
| 3793/3794 | I77V/F78L/R200A/F226L/Q339I | + |
| 3953/3954 | Q32P/I210L/G232N/I273Q/I368Q/G373D | + |
| 3897/3898 | Q32P/E106R/I210L | + |
| 3785/3786 | Q32P/E235T/I273Q | + |
| 3767/3768 | F78L/F226L/Q290R | + |
| 3829/3830 | P14E/F78L/R200A/F226L/Q290R/Q339I | + |
| 3771/3772 | F78L/F226L/N230I | + |
| 3781/3782 | P14E/I77V/T201L/N230I | + |
| 3893/3894 | S15G/I77V | + |
| 3921/3922 | G232N/E235T | + |
| 3955/3956 | Q32P | + |

Levels of increased activity were determined relative to the reference polypeptide of SEQ ID NO: 3488 and defined as follows:
"+" 1.03 to 1.18, "++" >1.18, "+++" >1.30

Example 77

Improvements Over SEQ ID NO: 3958 in the Extension of Oligonucleotide Acceptor Molecules with Nucleotide Triphosphate Donors HTP Screening for Improved TdT Variants SEQ ID NO: 3958 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 77.1.

Reactions were performed in 96-well format 200 μL BioRad PCR plates. Reactions included 1-4 μM oligonucleotide, 5-50 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 77.1. The quenched reactions were centrifuged at 4,000 rpm for 10 min at 4° C. to pellet any precipitate. Supernatant was then transferred into new HTP plates for analytical analysis as described in Table 77.1.

TABLE 77.1

| All lysis, purification, reaction, quench, and analytical properties |
|---|
| Lysis and purification conditions : Lysis buffer-20 mM Tris-acetate, pH 8, 0.2 g/L lysozyme from chicken egg white; Lysis buffer volume-400 μL; Lysate pre-treatment-Lysates were preincubated at 60° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide-2 μM TTTTTTTCGA; Nucleotide triphosphate-25 μM 3'PO4-dCTP; Reaction buffer-20 mM MOPS, pH 7.2, 0.002 Unit/μL yeast pyrophosphatase (Thermo Scientific), 50 mM potassium acetate, 250 μM cobalt (II) chloride; Reaction volume-20 μL; Lysate dilution-8x dilution prior to adding to the reaction; Reaction temperature-60° C.; Reaction time-15 minutes |
| Quench conditions: Quench solution and volume-Reactions were quenched by the addition of 24 μL acetonitrile. The solutions were mixed well and then further diluted by the addition of 16 μL of 20 mM aqueous EDTA.; Plate type and seal-96-well BioRad PCR plate with a plastic seal |
| Analytical conditions: Instrument-Agilent UHPLC 1260 prime series, Agilent Ultivo-see Example 4; Reaction product detected-TTTTTTTCGAC-3'PO4 |

Activity relative to SEQ ID NO: 3958 (Activity FIOP) was calculated as the product peak area of the variant compared with the product peak area observed by the reaction with SEQ ID NO: 3958 (where the peak area may be set as the average of replicates or else the highest single sample as appropriate). The results are shown in Table 77.2.

TABLE 77

| SEQ ID NO: (nt/aa) | Amino Acid Differences (Relative to SEQ ID NO: 3958) | FIOP Product Peak Area Relative to SEQ ID NO: 3958 |
|---|---|---|
| 3959/3960 | I321V | +++ |
| 3961/3962 | G383V | +++ |
| 3963/3964 | I273P | +++ |
| 3965/3966 | E388H | +++ |
| 3967/3968 | E350W | +++ |
| 3969/3970 | S371G | +++ |
| 3971/3972 | A275R | +++ |
| 3973/3974 | K272R | +++ |
| 3975/3976 | F324R | +++ |
| 3977/3978 | E325T | +++ |
| 3979/3980 | G380S | ++ |
| 3981/3982 | I321C | ++ |
| 3983/3984 | Y386W | ++ |
| 3985/3986 | T322A | ++ |
| 3987/3988 | G380T | ++ |
| 3989/3990 | Y347F | ++ |
| 3991/3992 | Y347W | ++ |
| 3993/3994 | E53T | ++ |
| 3995/3996 | L370Y | ++ |
| 3997/3998 | I321S | ++ |
| 3999/4000 | Q267G | ++ |
| 4001/4002 | Q339M | ++ |
| 4003/4004 | G383D | ++ |
| 4005/4006 | E325H | ++ |
| 4007/4008 | G383E | ++ |
| 4009/4010 | L355P | ++ |
| 4011/4012 | A275Q | + |
| 4013/4014 | F324E | + |
| 4015/4016 | D277S | + |
| 4017/4018 | E325A | + |
| 4019/4020 | V264E | + |
| 4021/4022 | E265P | + |
| 4023/4024 | F324L | + |
| 4025/4026 | T262R | + |
| 4027/4028 | 1273V | + |
| 4029/4030 | F324P | + |
| 4031/4032 | S270N | + |
| 4033/4034 | V264S | + |
| 4035/4036 | S371E | + |
| 4037/4038 | A275G | + |
| 4039/4040 | R346L | + |
| 4041/4042 | G266D | + |
| 4043/4044 | R360S | + |

TABLE 77-continued

| SEQ ID NO: (nt/aa) | Amino Acid Differences (Relative to SEQ ID NO: 3958) | FIOP Product Peak Area Relative to SEQ ID NO: 3958 |
|---|---|---|
| 4045/4046 | E325K | + |
| 4047/4048 | F324A | + |
| 4049/4050 | R360N | + |
| 4051/4052 | G266T | + |
| 4053/4054 | E376A | + |
| 4055/4056 | P271G | + |
| 4057/4058 | A275K | + |
| 4059/4060 | E325V | + |
| 4061/4062 | Q267S | + |

Levels of increased activity were determined relative to the reference polypeptide of SEQ ID NO: 3958 and defined as follows:
"+" 1.00 to 1.07, "++" >1.07, "+++" >1.16

Example 78

Improvements Over SEQ ID NO: 3958 in the Extension of Oligonucleotide Acceptor Molecules with Nucleotide Triphosphate Donors HTP Screening for Improved TdT Variants SEQ ID NO: 3958 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 78.1.

Reactions were performed in 96-well format 200 µL BioRad PCR plates. Reactions included 1-4 µM oligonucleotide, 5-50 µM nucleotide triphosphate, 0.002 Unit/µL yeast pyrophosphatase (Thermo Scientific), 20 mM buffer, 50 mM potassium acetate, and 250 µM cobalt (II) chloride. The reactions were set up as follows: (i) all reaction components, except for TdT, were pre-mixed in a single solution, and 15 µL of this solution was aliquoted into each well of the 96-well plates (ii) 5 µL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 78.1. The quenched reactions were centrifuged at 4,000 rpm for 10 min at 4° C. to pellet any precipitate. Supernatant was then transferred into new HTP plates for analytical analysis as described in Table 78.1.

TABLE 78.1

| All lysis, purification, reaction, quench, and analytical properties |
|---|
| Lysis and purification conditions: Lysis buffer-20 mM Tris-acetate, pH 8, 0.2 g/L lysozyme from chicken egg white; Lysis buffer volume-400 µL; Lysate pre-treatment-Lysates were preincubated at 60° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide-2 µM TTTTTTTGTT; Nucleotide triphosphate-25 µM 3'P04-dCTP; Reaction buffer-20 mM MOPS, pH 7.2, 0.002 Unit/µL yeast pyrophosphatase (Thermo Scientific), 50 mM potassium acetate, 250 µM cobalt (II) chloride; Reaction volume-20 µL; Lysate dilution-8x dilution prior to adding to the reaction; Reaction temperature-60° C.; Reaction time-15 minutes |
| Quench conditions: Quench solution and volume-Reactions were quenched by the addition of 24 µL acetonitrile. The solutions were mixed well and then further diluted by the addition of 16 µL of 20 mM aqueous EDTA.; Plate type and seal-96-well BioRad PCR plate with a plastic seal |
| Analytical conditions: Instrument-Agilent UHPLC 1260 prime series, Agilent Ultivo-see Example 4; Reaction product detected-TTTTTTTGTTC-3'PO4 |

Activity relative to SEQ ID NO: 3958 (Activity FIOP) was calculated as the product peak area of the variant compared with the product peak area observed by the reaction with SEQ ID NO: 3958 (where the peak area may be set as the average of replicates or else the highest single sample as appropriate). The results are shown in Table 78.2.

TABLE 78

| SEQ ID NO: (nt/aa) | Amino Acid Differences (Relative to SEQ ID NO: 3958) | FIOP Product Peak Area Relative to SEQ ID NO: 3958 |
|---|---|---|
| 3967/3968 | E350W | +++ |
| 3965/3966 | E388H | +++ |
| 3991/3992 | Y347W | +++ |
| 3969/3970 | S371G | +++ |
| 3963/3964 | I273P | +++ |
| 4001/4002 | Q339M | +++ |
| 4037/4038 | A275G | +++ |
| 3975/3976 | F324R | +++ |
| 4009/4010 | L355P | +++ |
| 3971/3972 | A275R | +++ |
| 3961/3962 | G383V | +++ |
| 3985/3986 | T322A | +++ |
| 4003/4004 | G383D | +++ |
| 3959/3960 | I321V | ++ |
| 4063/4064 | E325R | ++ |
| 3987/3988 | G380T | ++ |
| 4065/4066 | G383T | ++ |
| 3999/4000 | Q267G | ++ |
| 4057/4058 | A275K | ++ |
| 3989/3990 | Y347F | ++ |
| 4027/4028 | 1273V | ++ |
| 4005/4006 | E325H | ++ |
| 3973/3974 | K272R | ++ |
| 4039/4040 | R346L | ++ |
| 4031/4032 | S270N | ++ |
| 4013/4014 | F324E | ++ |
| 3993/3994 | E53T | ++ |
| 4067/4068 | E325P | ++ |
| 4069/4070 | E325G | ++ |
| 4017/4018 | E325A | ++ |
| 4007/4008 | G383E | ++ |
| 4071/4072 | P271T | ++ |
| 3979/3980 | G380S | ++ |
| 4021/4022 | E265P | ++ |
| 4073/4074 | F324D | + |
| 4053/4054 | E376A | + |
| 4055/4056 | P271G | + |
| 4023/4024 | F324L | + |
| 4061/4062 | Q267S | + |
| 4075/4076 | T229V | + |
| 3983/3984 | Y386W | + |
| 4047/4048 | F324A | + |
| 3995/3996 | L370Y | + |
| 4015/4016 | D277S | + |
| 4043/4044 | R360S | + |
| 4049/4050 | R360N | + |
| 4077/4078 | R346Q | + |
| 4079/4080 | N278G | + |
| 4081/4082 | N278P | + |
| 4083/4084 | F324V | + |
| 4085/4086 | Q280S | + |
| 4087/4088 | A275S | + |
| 4045/4046 | E325K | + |
| 4041/4042 | G266D | + |
| 4089/4090 | L387I | + |
| 4091/4092 | E376T | + |
| 4029/4030 | F324P | + |
| 4019/4020 | V264E | + |
| 4051/4052 | G266T | + |
| 4093/4094 | P219T | + |
| 3997/3998 | I321S | + |
| 4035/4036 | S371E | + |
| 4095/4096 | E376R | + |
| 4025/4026 | T262R | + |
| 4059/4060 | E325V | + |
| 4097/4098 | W390A | + |
| 4099/4100 | Q267E | + |
| 3981/3982 | I321C | + |
| 4011/4012 | A275Q | + |

Levels of increased activity were determined relative to the reference polypeptide of SEQ ID NO: 3958 and defined as follows:
"+" 1.01 to 1.11, "++" >1.11, "+++" >1.23

Example 79

Improvements Over SEQ ID NO: 3958 in the Extension of Oligonucleotide Acceptor Molecules with Nucleotide Triphosphate Donors HTP Screening for Improved TdT Variants SEQ ID NO: 3958 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 79.1.

Reactions were performed in 96-well format 200 µL BioRad PCR plates. Reactions included 1-4 µM oligonucleotide, 5-50 µM nucleotide triphosphate, 0.002 Unit/µL yeast pyrophosphatase (Thermo Scientific), 20 mM buffer, 50 mM potassium acetate, and 250 µM cobalt (II) chloride. The reactions were set up as follows: (i) all reaction components, except for TdT, were pre-mixed in a single solution, and 15 µL of this solution was aliquoted into each well of the 96-well plates (ii) 5 µL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 79.1. The quenched reactions were centrifuged at 4,000 rpm for 10 min at 4° C. to pellet any precipitate. Supernatant was then transferred into new HTP plates for analytical analysis as described in Table 79.1.

TABLE 79.1

| All lysis, purification, reaction, quench, and analytical properties |
|---|
| Lysis and purification conditions: Lysis buffer-20 mM Tris-acetate, pH 8, 0.2 g/L lysozyme from chicken egg white; Lysis buffer volume-400 µL; Lysate pre-treatment-Lysates were preincubated at 64° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide-2 µM TTTTTTTATC; Nucleotide triphosphate-25 uM 3'P04-dATP; Reaction buffer-20 mM MOPS, pH 7.2, 0.002 Unit/µL yeast pyrophosphatase (Thermo Scientific), 50 mM potassium acetate, 250 µM cobalt (II) chloride; Reaction volume-20 µL; Lysate dilution-4x dilution prior to adding to the reaction; Reaction temperature-64° C.; Reaction time-15 minutes |

TABLE 79.1-continued

| All lysis, purification, reaction, quench, and analytical properties |
|---|
| Quench conditions: Quench solution and volume-Reactions were quenched by the addition of 24 μL acetonitrile. The solutions were mixed well and then further diluted by the addition of 16 μL of 20 mM aqueous EDTA.; Plate type and seal-96-well BioRad PCR plate with a plastic seal<br>Analytical conditions: Instrument-Agilent UHPLC 1260 prime series, Agilent Ultivo-see Example 4; Reaction product detected-TTTTTTTATCA-3'PO4 |

Activity relative to SEQ ID NO: 3958 (Activity FIOP) was calculated as the product peak area of the variant compared with the product peak area observed by the reaction with SEQ ID NO: 3958 (where the peak area may be set as the average of replicates or else the highest single sample as appropriate). The results are shown in Table 79.2.

TABLE 79.2

| SEQ ID NO: (nt/aa) | Amino Acid Differences (Relative to SEQ ID NO: 3958) | FIOP Product Peak Area Relative to SEQ ID NO: 3958 |
|---|---|---|
| 4001/4002 | Q339M | +++ |
| 4073/4074 | F324D | +++ |
| 4031/4032 | S270N | +++ |
| 4101/4102 | E349V | +++ |
| 3959/3960 | I321V | +++ |
| 4063/4064 | E325R | +++ |
| 3963/3964 | I273P | +++ |
| 4019/4020 | V264E | ++ |
| 4085/4086 | Q280S | ++ |
| 4045/4046 | E325K | ++ |
| 3985/3986 | T322A | ++ |
| 4009/4010 | L355P | ++ |
| 4007/4008 | G383E | ++ |
| 3989/3990 | Y347F | ++ |
| 4023/4024 | F324L | ++ |
| 4043/4044 | R360S | ++ |
| 4013/4014 | F324E | ++ |
| 4103/4104 | K72R | + |
| 3973/3974 | K272R | + |
| 4105/4106 | E349S | + |
| 4083/4084 | F324V | + |
| 3975/3976 | F324R | + |
| 4003/4004 | G383D | + |
| 4107/4108 | E349A | + |
| 4027/4028 | I273V | + |
| 4109/4110 | V264Q | + |
| 3997/3998 | I321S | + |
| 4111/4112 | R360T | + |
| 4113/4114 | Q267M | + |
| 4115/4116 | R346S | + |
| 4033/4034 | V264S | + |
| 4117/4118 | R360G | + |

TABLE 79.2-continued

| SEQ ID NO: (nt/aa) | Amino Acid Differences (Relative to SEQ ID NO: 3958) | FIOP Product Peak Area Relative to SEQ ID NO: 3958 |
|---|---|---|
| 4119/4120 | S371R | + |
| 4055/4056 | P271G | + |

Levels of increased activity were determined relative to the reference polypeptide of SEQ ID NO: 3958 and defined as follows:
"+" 1.09 to 1.33, "++" >1.33, "+++" >1.46

Example 80

Improvements Over SEQ ID NO: 3788 in the Extension of Oligonucleotide Acceptor Molecules with Nucleotide Triphosphate Donors HTP Screening for Improved TdT Variants SEQ ID NO: 3788 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 80.1.

Reactions were performed in 96-well format 200 μL BioRad PCR plates. Reactions included 1-4 μM oligonucleotide, 5-50 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 80.1. The quenched reactions were centrifuged at 4,000 rpm for 10 min at 4° C. to pellet any precipitate. Supernatant was then transferred into new HTP plates for analytical analysis as described in Table 80.1.

TABLE 80.1

| All lysis, purification, reaction, quench, and analytical properties |
|---|
| Lysis and purification conditions: Lysis buffer-20 mM Tris-acetate, pH 8, 0.2 g/L lysozyme from chicken egg white; Lysis buffer volume-400 μL; Lysate pre-treatment-Lysates were preincubated at 60° C. for one hour, then centrifuged at 4,000 rpm for 10 min as described in Example 2 [Lysis of HTP Cell Pellets with Lysozyme]. The clarified supernatants were used in reactions.<br>Reaction conditions: Oligonucleotide-4 μM TTTTTTTCGG; Nucleotide triphosphate-50 μM 3'PO4-dGTP; Reaction buffer-20 mM MOPS, pH 7.2, 0.002 Unit/μL yeast pyrophosphatase (Thermo Scientific), 50 mM potassium acetate, 250 μM cobalt (II) chloride; Reaction volume-36 μL; Lysate dilution-16x dilution prior to adding to the reaction; Reaction temperature-60° C.; Reaction time-15 minutes |

TABLE 80.1-continued

| All lysis, purification, reaction, quench, and analytical properties |
|---|
| Quench conditions: Quench solution and volume-Reactions were quenched by adding two volumes of 90% acetonitrile and 10% methanol mixture and clarifying by centrifugation; Plate type and seal-384-well microtiter plate with seal |
| Analytical conditions: Instrument-Agilent RapidFire SPE-MS/MS-see Example 6; Reaction product detected-TTTTTTTCGGG-3'PO4 |

Activity relative to SEQ ID NO: 3788 (Activity FIOP) was calculated as the product peak area of the variant compared with the product peak area observed by the reaction with SEQ ID NO: 3788 (where the peak area may be set as the average of replicates or else the highest single sample as appropriate). The results are shown in Table 80.2.

TABLE 80.2

| SEQ ID NO: (nt/aa) | Amino Acid Differences (Relative to SEQ ID NO: 3788) | FIOP Product Peak Area Relative to SEQ ID NO: 3788 |
|---|---|---|
| 4121/4122 | Q32P/D103P/L207E/I321M/L344T | +++ |
| 4123/4124 | I273P/F279H/G373D | +++ |
| 4125/4126 | L207E/I210L/I273P/F279H/L344T | +++ |
| 4127/4128 | Q32P/I273P/L344T/G373D | +++ |
| 4129/4130 | L207E/I273P | ++ |
| 4131/4132 | I210L | ++ |
| 4133/4134 | E106R/E111V/R200A/E235T/I368Q | ++ |
| 4135/4136 | Q32P/F279H/I321M | ++ |
| 4137/4138 | I273P/F279H | ++ |
| 4139/4140 | I210L/I273P/F279H | ++ |
| 4141/4142 | V104L/E106R | ++ |
| 4143/4144 | Q32P/D103P/L207E/I210L/L344T/E349S | ++ |
| 4145/4146 | E106Q/R200A/T201R/I368Q | + |
| 4147/4148 | Q32P/L207E/I210L/F279H | + |
| 4149/4150 | E106R/R200A/T201R/T209A/I368Q | + |
| 4151/4152 | V104L/E106R/R200A/T201R/L2681 | + |
| 4153/4154 | I210L/F279H | + |
| 4155/4156 | L207E/I210L/I273P/I321M/L344T/E349S | + |
| 4157/4158 | E106Q/T201L/E235T | + |
| 4159/4160 | T201L/I368Q | + |
| 4161/4162 | E111V | + |
| 4163/4164 | Q32P/F279H | + |
| 4165/4166 | R200A/E235T/I368Q | + |
| 4167/4168 | V104L/E106Q/E111V/R200A/T201L/E235T/L268 I/I368Q | + |
| 4169/4170 | E106R/R200A/T201L | + |

Levels of increased activity were determined relative to the reference polypeptide of SEQ ID NO: 3788 and defined as follows:
"+" 1.01 to 1.27, "++" >1.27, "+++" >1.74

Example 81

Improvements Over SEQ ID NO: 3788 in the Extension of Oligonucleotide Acceptor Molecules with Nucleotide Triphosphate Donors HTP Screening for Improved TdT Variants SEQ ID NO: 3788 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 81.1.

Reactions were performed in 96-well format 200 μL BioRad PCR plates. Reactions included 1-4 μM oligonucleotide, 5-50 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 81.1. The quenched reactions were centrifuged at 4,000 rpm for 10 min at 4° C. to pellet any precipitate. Supernatant was then transferred into new HTP plates for analytical analysis as described in Table 81.1.

TABLE 81.1

| All lysis, purification, reaction, quench, and analytical properties |
| --- |
| Lysis and purification conditions : Lysis buffer-20 mM Tris-acetate, pH 8, 0.2 g/L lysozyme from chicken egg white; Lysis buffer volume-400 μL; Lysate pre-treatment-Lysates were preincubated at 60° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide-4 μM TTTTTTTACA; Nucleotide triphosphate-50 μM 3'PO4-dTTP; Reaction buffer-20 mM MOPS, pH 7.2, 0.002 Unit/μL yeast pyrophosphatase (Thermo Scientific), 50 mM potassium acetate, 250 μM cobalt (II) chloride; Reaction volume-36 μL; Lysate dilution-16x dilution prior to adding to the reaction; Reaction temperature-60° C.; Reaction time-15 minutes |
| Quench conditions: Quench solution and volume-Reactions were quenched by adding two volumes of 90% acetonitrile and 10% methanol mixture and clarifying by centrifugation; Plate type and seal-384-well microtiter plate with seal |
| Analytical conditions: Instrument-Agilent RapidFire SPE-MS/MS-see Example 6; Reaction product detected-TTTTTTTACAT-3'PO4 |

Activity relative to SEQ ID NO: 3788 (Activity FIOP) was calculated as the product peak area of the variant compared with the product peak area observed by the reaction with SEQ ID NO: 3788 (where the peak area may be set as the average of replicates or else the highest single sample as appropriate). The results are shown in Table 81.2.

TABLE 81

| SEQ ID NO: (nt/aa) | Amino Acid Differences (Relative to SEQ ID NO: 3788) | FIOP Product Peak Area Relative to SEQ ID NO: 3788 |
| --- | --- | --- |
| 4129/4130 | L207E/I273P | +++ |
| 4133/4134 | E106R/E111V/R200A/E235T/I368Q | +++ |
| 4137/4138 | I273P/F279H | +++ |
| 4157/4158 | E106Q/T201L/E235T | +++ |
| 4155/4156 | L207E/I210L/I273P/I321M/L344T/E349S | +++ |
| 4169/4170 | E106R/R200A/T201L | +++ |
| 4139/4140 | I210L/I273P/F279H | +++ |
| 4131/4132 | I210L | +++ |
| 4123/4124 | I273P/F279H/G373D | ++ |
| 4171/4172 | I210L/F279H | ++ |
| 4127/4128 | Q32P/I273P/L344T/G373D | ++ |
| 4125/4126 | L207E/I210L/I273P/F279H/L344T | ++ |
| 4121/4122 | Q32P/D103P/L207E/I321M/L344T | ++ |
| 4173/4174 | E106Q/R200A/T201R/E235T | ++ |
| 4175/4176 | E106R/E111V/R200A/T201L | ++ |
| 4177/4178 | I210L/I273P/F279H/E349S | ++ |
| 4179/4180 | Q32P/I273P/F279H/L344T/E349S | ++ |
| 4161/4162 | E111V | ++ |
| 4181/4182 | L207E/F279H/E349S | ++ |
| 4183/4184 | E106R/E111V/T201R/I368Q | ++ |
| 4185/4186 | L207E/I210L/I273P/F279H/L344T/E349S/G373D | ++ |
| 4187/4188 | E111V/R200A/T201R/L268I | + |
| 4143/4144 | Q32P/D103P/L207E/I210L/L344T/E349S | + |
| 4167/4168 | V104L/E106Q/E111V/R200A/T201L/E235T/L268I/I368Q | + |
| 4163/4164 | Q32P/F279H | + |
| 4135/4136 | Q32P/F279H/I321M | + |
| 4189/4190 | E106R | + |
| 4191/4192 | E106R/E111V/T201L | + |
| 4141/4142 | V104L/E106R | + |
| 4147/4148 | Q32P/L207E/I210L/F279H | + |
| 4193/4194 | V104L/E106R/E111V/T201R/E235T/I368Q | + |
| 4195/4196 | V104L/E106R/E111V/R200A/T201L/L268I | + |
| 4197/4198 | Q32P/D103P/I321M/L344T | + |
| 4199/4200 | E111V/R200A/I368Q | + |
| 4201/4202 | E106R/T201R/L268I | + |
| 4203/4204 | R200A/I368Q | + |
| 4205/4206 | Q32P/L207E/I273P/F279H/I321M | + |
| 4207/4208 | E106R/E111V/R200A/T201R/L268I/I368Q | + |
| 4165/4166 | R200A/E235T/I368Q | + |
| 4209/4210 | Q32P/L207E/L344T | + |
| 4211/4212 | E106R/E111V/R200A/T201L/L268I/I368Q | + |
| 4213/4214 | Q32P/L207E/F279H | + |

Levels of increased activity were determined relative to the reference polypeptide of SEQ ID NO: 3788 and defined as follows:
"+" 1.00 to 1.17, "++" >1.17, "+++" >1.35

Example 82

Improvements Over SEQ ID NO: 4124 in the Extension of Oligonucleotide Acceptor Molecules with Nucleotide Triphosphate Donors HTP Screening for Improved TdT Variants SEQ ID NO: 4124 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 82.1.

Reactions were performed in 96-well format 200 μL BioRad PCR plates. Reactions included 1-4 μM oligonucleotide, 5-50 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 82.1. The quenched reactions were centrifuged at 4,000 rpm for 10 min at 4° C. to pellet any precipitate. Supernatant was then transferred into new HTP plates for analytical analysis as described in Table 82.1.

TABLE 82.1

| All lysis, purification, reaction, quench, and analytical properties |
|---|
| Lysis and purification conditions: Lysis buffer-20 mM Tris-acetate, pH 8, 0.2 g/L lysozyme from chicken egg white; Lysis buffer volume-400 μL; Lysate pre-treatment-Lysates were preincubated at 65° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide-4 μM TTTTTTTATC; Nucleotide triphosphate-50 μM 3'PO4-dATP; Reaction buffer-20 mM MOPS, pH 7.2, 0.002 Unit/μL yeast pyrophosphatase (Thermo Scientific), 50 mM potassium acetate, 250 μM cobalt (II) chloride; Reaction volume-36 μL; Lysate dilution-16x dilution prior to adding to the reaction; Reaction temperature-65° C.; Reaction time-15 minutes |
| Quench conditions: Quench solution and volume-Reactions were quenched by adding two volumes of 90% acetonitrile and 10% methanol mixture and clarifying by centrifugation; Plate type and seal-384-well microtiter plate with seal |
| Analytical conditions: Instrument-Agilent RapidFire SPE-MS/MS-see Example 6; Reaction product detected-TTTTTTTATCA-3'PO4 |

Activity relative to SEQ ID NO: 4124 (Activity FIOP) was calculated as the product peak area of the variant compared with the product peak area observed by the reaction with SEQ ID NO: 4124 (where the peak area may be set as the average of replicates or else the highest single sample as appropriate). The results are shown in Table 82.2.

TABLE 82.2

| SEQ ID NO: (nt/aa) | Amino Acid Differences (Relative to SEQ ID NO: 4124) | FIOP Product Peak Area Relative to SEQ ID NO: 4124 |
|---|---|---|
| 4215/4216 | R200A/S270N | +++ |
| 4217/4218 | Q32P/E235T/K272R/Q339M | +++ |
| 4219/4220 | Q32P/E111V/E235T/Q339M | +++ |
| 4221/4222 | E106R/R200A/I321V/T322A/G383D | +++ |
| 4223/4224 | E235T/Q339M/Y386W | +++ |
| 4225/4226 | S270N/T322A/L344T/G383D | +++ |
| 4227/4228 | E235T/Q339M | +++ |
| 4229/4230 | E235T/K272R/Q339M | +++ |
| 4231/4232 | R200A/L344T | +++ |
| 4233/4234 | Q32P/E235T/Q339M/Y386W | +++ |
| 4235/4236 | L344T | ++ |
| 4237/4238 | E235T/P271G/Q339M/Y386W | ++ |
| 4239/4240 | R200A | ++ |
| 4241/4242 | E111V/E235T | ++ |
| 4243/4244 | Q32P/E111V/E235T/Q339N | ++ |
| 4245/4246 | E235T/P271G/K272R/Q339M/Y386W | ++ |
| 4247/4248 | Q32P/P271G/Q339M | ++ |
| 4249/4250 | Q32P/E111V/E235T | ++ |
| 4251/4252 | E111V/E235T/K272R/Q339N/Y386W | ++ |
| 4253/4254 | E111V/E235T/P271G/Q339N | ++ |
| 4255/4256 | E235T/Q339N/Y386W | ++ |
| 4257/4258 | E235T | ++ |
| 4259/4260 | R200A/S270N/T322A/G383D | ++ |
| 4261/4262 | Q32P/E235T/Q339N/Y386W | ++ |
| 4263/4264 | Q32P/E235T | + |
| 4265/4266 | C68G/E106R/R200A | + |
| 4267/4268 | E235T/Q339N | + |

TABLE 82.2-continued

| SEQ ID NO: (nt/aa) | Amino Acid Differences (Relative to SEQ ID NO: 4124) | FIOP Product Peak Area Relative to SEQ ID NO: 4124 |
|---|---|---|
| 4269/4270 | Q32P/E235T/K272R | + |
| 4271/4272 | Q32P/E111V/E235T/Y386W | + |
| 4273/4274 | A74V/E106R/S270N/L344T | + |
| 4275/4276 | F324R | + |
| 4277/4278 | Q32P | + |
| 4279/4280 | E235T/K272R/Y386W | + |
| 4281/4282 | E325H | + |
| 4283/4284 | E106R/S270N/L344T | + |
| 4285/4286 | C68G/L344T/G383D | + |
| 4287/4288 | Q32P/E235T/K272R/Y386W | + |
| 4289/4290 | Q32P/K272R | + |
| 4291/4292 | Q32P/E111V/E235T/P271G/K272R/Q339T | + |
| 4293/4294 | E111V/K272R/Q339N/Y386W | + |
| 4295/4296 | E235T/K272R | + |
| 4297/4298 | D103P/F324E | + |
| 4299/4300 | E235T/K272R/Q339T | + |
| 4301/4302 | Q32P/E235T/P271G/Q339T | + |
| 4303/4304 | E235T/P271G/Q339N | + |
| 4305/4306 | E111V/E235T/Q339T | + |
| 4307/4308 | L344T/L370Y | + |
| 4309/4310 | L370Y | + |

Levels of increased activity were determined relative to the reference polypeptide of SEQ ID NO: 4124 and defined as follows:
"+" 1.19 to 2.10, "++" >2.10, "+++" >3.24

Example 83

Improvements Over SEQ ID NO: 4124 in the Extension of Oligonucleotide Acceptor Molecules with Nucleotide Triphosphate Donors HTP Screening for Improved TdT Variants SEQ ID NO: 4124 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 83.1.

Reactions were performed in 96-well format 200 μL BioRad PCR plates. Reactions included 1-4 μM oligonucleotide, 5-50 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 83.1. The quenched reactions were centrifuged at 4,000 rpm for 10 min at 4° C. to pellet any precipitate. Supernatant was then transferred into new HTP plates for analytical analysis as described in Table 83.1.

TABLE 83.1

| All lysis, purification, reaction, quench, and analytical properties |
|---|
| Lysis and purification conditions: Lysis buffer-20 mM Tris-acetate, pH 8, 0.2 g/L lysozyme from chicken egg white; Lysis buffer volume-400 μL; Lysate pre-treatment-Lysates were preincubated at 60° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide-4 μM TTTTTTTACA; Nucleotide triphosphate-50 μM 3'PO4-dTTP; Reaction buffer-20 mM MOPS, pH 7.2, 0.002 Unit/μL yeast pyrophosphatase (Thermo Scientific), 50 mM potassium acetate, 250 μM cobalt (II) chloride; Reaction volume-36 μL; Lysate dilution-64x dilution prior to adding to the reaction; Reaction temperature-60° C.; Reaction time-15 minutes |
| Quench conditions: Quench solution and volume-Reactions were quenched by adding two volumes of 90% acetonitrile and 10% methanol mixture and clarifying by centrifugation; Plate type and seal-384-well microtiter plate with seal |
| Analytical conditions: Instrument-Agilent RapidFire SPE-MS/MS-see Example 6; Reaction product detected-TTTTTTTACAT-3'PO4 |

Activity relative to SEQ ID NO: 4124 (Activity FIOP) was calculated as the product peak area of the variant compared with the product peak area observed by the reaction with SEQ ID NO: 4124 (where the peak area may be set as the average of replicates or else the highest single sample as appropriate). The results are shown in Table 83.2.

TABLE 83

| SEQ ID NO: (nt/aa) | Amino Acid Differences (Relative to SEQ ID NO: 4124) | FIOP Product Peak Area Relative to SEQ ID NO: 4124 |
|---|---|---|
| 4215/4216 | R200A/S270N | +++ |
| 4273/4274 | A74V/E106R/S270N/L344T | +++ |
| 4311/4312 | R200A | +++ |
| 4225/4226 | S270N/T322A/L344T/G383D | +++ |
| 4231/4232 | R200A/L344T | +++ |
| 4297/4298 | D103P/F324E | +++ |
| 4275/4276 | F324R | +++ |
| 4259/4260 | R200A/S270N/T322A/G383D | +++ |
| 4251/4252 | E111V/E235T/K272R/Q339N/Y386W | +++ |
| 4235/4236 | L344T | +++ |
| 4265/4266 | C68G/E106R/R200A | ++ |
| 4223/4224 | E235T/Q339M/Y386W | ++ |
| 4255/4256 | E235T/Q339N/Y386W | ++ |
| 4313/4314 | C68G/R200A/S270N/I321V | ++ |
| 4261/4262 | Q32P/E235T/Q339N/Y386W | ++ |
| 4315/4316 | C68G/R200A | ++ |
| 4285/4286 | C68G/L344T/G383D | ++ |
| 4287/4288 | Q32P/E235T/K272R/Y386W | ++ |
| 4293/4294 | E111V/K272R/Q339N/Y386W | ++ |
| 4221/4222 | E106R/R200A/I321V/T322A/G383D | ++ |
| 4281/4282 | E325H | ++ |
| 4227/4228 | E235T/Q339M | ++ |
| 4219/4220 | Q32P/E111V/E235T/Q339M | ++ |
| 4229/4230 | E235T/K272R/Q339M | ++ |
| 4317/4318 | Q32P/E111V/E235T/Y386W | ++ |
| 4279/4280 | E235T/K272R/Y386W | ++ |
| 4319/4320 | T262R | + |
| 4241/4242 | E111V/E235T | + |
| 4267/4268 | E235T/Q339N | + |
| 4295/4296 | E235T/K272R | + |
| 4321/4322 | E235T | + |
| 4323/4324 | C68G/S270N/I321V/T322A | + |
| 4325/4326 | N278R | + |
| 4327/4328 | E349N | + |
| 4329/4330 | Q32P/E235T/Q339T/Y386W | + |
| 4249/4250 | Q32P/E111V/E235T | + |
| 4309/4310 | L370Y | + |
| 4299/4300 | E235T/K272R/Q339T | + |
| 4331/4332 | Q32P/E111V/E235T/Q339T/Y386W | + |
| 4217/4218 | Q32P/E235T/K272R/Q339M | + |
| 4305/4306 | E111V/E235T/Q339T | + |
| 4333/4334 | Q32P/E235T | + |
| 4233/4234 | Q32P/E235T/Q339M/Y386W | + |
| 4243/4244 | Q32P/E111V/E235T/Q339N | + |
| 4335/4336 | E235T/P271G/K272R/Q339N | + |
| 4337/4338 | Q32P/Q339N | + |
| 4339/4340 | C68G/E106R/I321V/T322A | + |
| 4283/4284 | E106R/S270N/L344T | + |
| 4341/4342 | T262R/E325H/E349N | + |
| 4343/4344 | T229V/E325H | + |
| 4307/4308 | L344T/L370Y | + |
| 4345/4346 | C68G/L344T | + |
| 4347/4348 | T229V | + |

Levels of increased activity were determined relative to the reference polypeptide of SEQ ID NO: 4124 and defined as follows: "+" 1.07 to 1.45, "++" >1.45, "+++" >1.76

Example 84

Improvements Over SEQ ID NO: 4124 in the Extension of Oligonucleotide Acceptor Molecules with Nucleotide Triphosphate Donors HTP Screening for Improved TdT Variants SEQ ID NO: 4124 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 84.1.

Reactions were performed in 96-well format 200 μL BioRad PCR plates. Reactions included 1-4 μM oligonucleotide, 5-50 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 84.1. The quenched reactions were centrifuged at 4,000 rpm for 10 min at 4° C. to pellet any precipitate. Supernatant was then transferred into new HTP plates for analytical analysis as described in Table 84.1.

TABLE 84.1

| All lysis, purification, reaction, quench, and analytical properties |
|---|
| Lysis and purification conditions : Lysis buffer-20 mM Tris-acetate, pH 8, 0.2 g/L lysozyme from chicken egg white; Lysis buffer volume-400 μL; Lysate pre-treatment-Lysates were preincubated at 60° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide-2 μM TTTTTTTCCA; Nucleotide triphosphate-50 μM 3'PO4-dCTP; Reaction buffer-20 mM MOPS, pH 7.2, 0.002 Unit/μL yeast pyrophosphatase (Thermo Scientific), 50 mM potassium acetate, 250 μM cobalt (II) chloride; Reaction volume-20 μL ; Lysate dilution-32× dilution prior to adding to the reaction; Reaction temperature-60° C.; Reaction time-15 minutes |
| Quench conditions: Quench solution and volume-Reactions were quenched by the addition of 24 μL acetonitrile. The solutions were mixed well and then further diluted by the addition of 16 μL of 20 mM aqueous EDTA. ; Plate type and seal-96-well BioRad PCR plate with a plastic seal |
| Analytical conditions: Instrument-Agilent UHPLC 1260 prime series, Agilent Ultivo-see Example 4; Reaction product detected-TTTTTTTCCAC-3'PO4 |

Activity relative to SEQ ID NO: 4124 (Activity FIOP) was calculated as the product peak area of the variant compared with the product peak area observed by the reaction with SEQ ID NO: 4124 (where the peak area may be set as the average of replicates or else the highest single sample as appropriate). The results are shown in Table 84.2.

TABLE 84.2

| SEQ ID NO: (nt/aa) | Amino Acid Differences (Relative to SEQ ID NO: 4124) | FIOP Product Peak Area Relative to SEQ ID NO: 4124 |
|---|---|---|
| 4349/4350 | D237P | +++ |
| 4351/4352 | E155Y | +++ |
| 4353/4354 | S304W | +++ |
| 4355/4356 | L193K | +++ |
| 4357/4358 | K164M | +++ |
| 4359/4360 | I26T | +++ |
| 4361/4362 | Y289D | +++ |
| 4363/4364 | L193D | +++ |
| 4365/4366 | S162P | +++ |
| 4367/4368 | K302L | +++ |
| 4369/4370 | E260N | +++ |
| 4371/4372 | H241P | +++ |
| 4373/4374 | T300M | +++ |
| 4375/4376 | E110S | +++ |
| 4377/4378 | N295L | +++ |
| 4379/4380 | K303G | +++ |
| 4381/4382 | V309C | +++ |
| 4383/4384 | T300P | +++ |
| 4385/4386 | K303Y | +++ |
| 4387/4388 | V309Q | +++ |
| 4389/4390 | S162F | +++ |
| 4391/4392 | S304V | +++ |
| 4393/4394 | D237S | +++ |
| 4395/4396 | A159R | +++ |
| 4397/4398 | A307S | +++ |
| 4399/4400 | L193G | +++ |
| 4401/4402 | N64Y | ++ |
| 4403/4404 | I54R | ++ |
| 4405/4406 | V309D | ++ |
| 4407/4408 | I26A | ++ |
| 4409/4410 | E308L | ++ |
| 4411/4412 | S162G | ++ |
| 4413/4414 | V244C | ++ |
| 4415/4416 | S296R | ++ |
| 4417/4418 | K89T | ++ |

TABLE 84.2-continued

| SEQ ID NO: (nt/aa) | Amino Acid Differences (Relative to SEQ ID NO: 4124) | FIOP Product Peak Area Relative to SEQ ID NO: 4124 |
|---|---|---|
| 4419/4420 | M306C | ++ |
| 4421/4422 | E144I | ++ |
| 4423/4424 | A275S/P291N | ++ |
| 4425/4426 | A159W | ++ |
| 4427/4428 | K164C | ++ |
| 4429/4430 | L193A | ++ |
| 4431/4432 | V309N | ++ |
| 4433/4434 | T300S | ++ |
| 4435/4436 | L193C | ++ |
| 4437/4438 | D294V | ++ |
| 4439/4440 | V293G | ++ |
| 4441/4442 | T300V | ++ |
| 4443/4444 | E308I | ++ |
| 4445/4446 | V244I | ++ |
| 4447/4448 | I258C | ++ |
| 4449/4450 | D294A | ++ |
| 4451/4452 | V309Y | ++ |
| 4453/4454 | N58D | ++ |
| 4455/4456 | Y44C/L193D | ++ |
| 4457/4458 | V293T | ++ |
| 4459/4460 | S181L | ++ |
| 4461/4462 | L174R | ++ |
| 4463/4464 | D237C | ++ |
| 4465/4466 | K89M | ++ |
| 4467/4468 | S184T | ++ |
| 4469/4470 | E63S | ++ |
| 4471/4472 | V154L | ++ |
| 4473/4474 | D305S | ++ |
| 4475/4476 | D294K | ++ |
| 4477/4478 | V309T | ++ |
| 4479/4480 | M306T | ++ |
| 4481/4482 | K161P | + |
| 4483/4484 | D99Q | + |
| 4485/4486 | M220Y | + |
| 4487/4488 | I258V | + |
| 4489/4490 | Q250R | + |
| 4491/4492 | I194L | + |
| 4493/4494 | K302G | + |
| 4495/4496 | L252S | + |
| 4497/4498 | I26Q | + |
| 4499/4500 | D99G | + |
| 4501/4502 | A190I | + |
| 4503/4504 | S162A | + |
| 4505/4506 | V243A | + |
| 4507/4508 | E308R | + |
| 4509/4510 | G9D/K302S | + |
| 4511/4512 | K303N | + |
| 4513/4514 | D189R | + |
| 4515/4516 | K62G | + |
| 4517/4518 | K47L | + |
| 4519/4520 | P291N | + |
| 4521/4522 | E110M | + |
| 4523/4524 | V293A | + |
| 4525/4526 | E308F | + |
| 4527/4528 | N58S | + |
| 4529/4530 | L163V | + |
| 4531/4532 | L246M | + |
| 4533/4534 | S162I | + |
| 4535/4536 | E110N | + |
| 4537/4538 | L246I | + |
| 4539/4540 | V293I | + |
| 4541/4542 | A307R | + |
| 4543/4544 | K248R | + |
| 4545/4546 | N295S | + |
| 4547/4548 | E110V | + |
| 4549/4550 | E70S | + |
| 4551/4552 | V293S | + |
| 4553/4554 | S301T | + |
| 4555/4556 | K170F | + |
| 4557/4558 | D189G | + |
| 4559/4560 | K249N | + |
| 4561/4562 | D237Y | + |
| 4563/4564 | M220S | + |
| 4565/4566 | D245G | + |
| 4567/4568 | A307E | + |
| 4569/4570 | P291R | + |

TABLE 84.2-continued

| SEQ ID NO: (nt/aa) | Amino Acid Differences (Relative to SEQ ID NO: 4124) | FIOP Product Peak Area Relative to SEQ ID NO: 4124 |
|---|---|---|
| 4571/4572 | D305P | + |
| 4573/4574 | T153C | + |
| 4575/4576 | V309R | + |
| 4577/4578 | I26F | + |
| 4579/4580 | D305T | + |
| 4581/4582 | K62A | + |
| 4583/4584 | V309L | + |
| 4585/4586 | D237T | + |
| 4587/4588 | K302C | + |
| 4589/4590 | D305V | + |
| 4591/4592 | E238S | + |
| 4593/4594 | D99N | + |
| 4595/4596 | I54V | + |
| 4597/4598 | T192L | + |
| 4599/4600 | S301G | + |
| 4601/4602 | K303Q | + |
| 4603/4604 | E308S | + |
| 4605/4606 | T153M | + |
| 4607/4608 | D99V | + |
| 4609/4610 | L193Y | + |
| 4611/4612 | A284S | + |
| 4613/4614 | N295P | + |

Levels of increased activity were determined relative to the reference polypeptide of SEQ ID NO: 4124 and defined as follows: "+" 1.00 to 1.12, "++" > 1.12, "+++" > 1.26

Example 85

Improvements Over SEQ ID NO: 4124 in the Extension of Oligonucleotide Acceptor Molecules with Nucleotide Triphosphate Donors HTP Screening for Improved TdT Variants SEQ ID NO: 4124 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 85.1.

Reactions were performed in 96-well format 200 µL BioRad PCR plates. Reactions included 1-4 µM oligonucleotide, 5-50 µM nucleotide triphosphate, 0.002 Unit/µL yeast pyrophosphatase (Thermo Scientific), 20 mM buffer, 50 mM potassium acetate, and 250 µM cobalt (II) chloride. The reactions were set up as follows: (i) all reaction components, except for TdT, were pre-mixed in a single solution, and 15 µL of this solution was aliquoted into each well of the 96-well plates (ii) 5 µL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 85.1. The quenched reactions were centrifuged at 4,000 rpm for 10 min at 4° C. to pellet any precipitate. Supernatant was then transferred into new HTP plates for analytical analysis as described in Table 85.1.

TABLE 85.1

All lysis, purification, reaction, quench, and analytical properties
Lysis and purification conditions : Lysis buffer-20 mM Tris-acetate, pH 8, 0.2 g/L lysozyme from chicken egg white; Lysis buffer volume-400 µL; Lysate pre-treatment-Lysates were preincubated at 68° C. for one hour, then centrifuged at 4,000 rpm for 10

TABLE 85.1-continued min as described in Example 2 [Lysis of HTP Cell Pellets with Lysozyme]. The clarified supernatants were used in reactions.
Reaction conditions: Oligonucleotide-2 µM TTTTTTTATC; Nucleotide triphosphate-25 µM 3'PO4-dATP; Reaction buffer-20 mM MOPS, pH 7.2, 0.002 Unit/µL yeast pyrophosphatase (Thermo Scientific), 50 mM potassium acetate, 250 µM cobalt (II) chloride; Reaction volume-36 µL ; Lysate dilution-8× dilution prior to adding to the reaction; Reaction temperature-68° C.; Reaction time-10 minutes
Quench conditions: Quench solution and volume-Reactions were quenched by adding two volumes of 90% acetonitrile and 10% methanol mixture and clarifying by centrifugation; Plate type and seal-384-well microtiter plate with seal
Analytical conditions: Instrument-Agilent RapidFire SPE-MS/MS-see Example 6; Reaction product detected-TTTTTTTATCA-3'PO4

Activity relative to SEQ ID NO: 4124 (Activity FIOP) was calculated as the product peak area of the variant compared with the product peak area observed by the reaction with SEQ ID NO: 4124 (where the peak area may be set as the average of replicates or else the highest single sample as appropriate). The results are shown in Table 85.2.

TABLE 85.2

| SEQ ID NO: (nt/aa) | Amino Acid Differences (Relative to SEQ ID NO: 4124) | FIOP Product Peak Area Relative to SEQ ID NO: 4124 |
|---|---|---|
| 4349/4350 | D237P | +++ |
| 4615/4616 | K196A | +++ |
| 4359/4360 | I26T | +++ |
| 4393/4394 | D237S | +++ |
| 4435/4436 | L193C | +++ |
| 4617/4618 | K302A | +++ |
| 4367/4368 | K302L | +++ |
| 4619/4620 | S143A | +++ |
| 4429/4430 | L193A | +++ |
| 4363/4364 | L193D | +++ |
| 4389/4390 | S162F | +++ |
| 4621/4622 | S301A | +++ |
| 4623/4624 | S162T | +++ |
| 4457/4458 | V293T | +++ |
| 4625/4626 | S162C | +++ |
| 4627/4628 | S184L | +++ |
| 4629/4630 | Y289M | +++ |
| 4391/4392 | S304V | +++ |
| 4561/4562 | D237Y | +++ |
| 4631/4632 | T192D | +++ |
| 4633/4634 | V309A | +++ |
| 4635/4636 | E110L | +++ |
| 4637/4638 | S301V | ++ |
| 4553/4554 | S301T | ++ |
| 4639/4640 | T300F | ++ |
| 4641/4642 | P291Y | ++ |
| 4643/4644 | K249S | ++ |
| 4479/4480 | M306T | ++ |
| 4611/4612 | A284S | ++ |
| 4645/4646 | S184Q | ++ |
| 4647/4648 | K62R | ++ |
| 4649/4650 | K62W | ++ |
| 4521/4522 | E110M | ++ |
| 4583/4584 | V309L | ++ |
| 4651/4652 | S304G | ++ |
| 4653/4654 | M306A | ++ |
| 4655/4656 | L253M | ++ |
| 4657/4658 | E110Y | ++ |
| 4659/4660 | A206P | ++ |
| 4585/4586 | D237T | ++ |
| 4661/4662 | M306G | ++ |
| 4509/4510 | G9D/K302S | ++ |
| 4663/4664 | V309F | ++ |

TABLE 85.2-continued

| SEQ ID NO: (nt/aa) | Amino Acid Differences (Relative to SEQ ID NO: 4124) | FIOP Product Peak Area Relative to SEQ ID NO: 4124 |
|---|---|---|
| 4547/4548 | E110V | ++ |
| 4665/4666 | D245C | ++ |
| 4609/4610 | L193Y | ++ |
| 4667/4668 | I194C | ++ |
| 4519/4520 | P291N | ++ |
| 4669/4670 | E110T | ++ |
| 4551/4552 | V293S | ++ |
| 4671/4672 | A190G | ++ |
| 4673/4674 | D205A | ++ |
| 4599/4600 | S301G | ++ |
| 4471/4472 | V154L | ++ |
| 4675/4676 | R148M | ++ |
| 4591/4592 | E238S | + |
| 4441/4442 | T300V | + |
| 4677/4678 | K303P | ++ |
| 4679/4680 | M306P | + |
| 4681/4682 | S304L | + |
| 4431/4432 | V309N | + |
| 4453/4454 | N58D | + |
| 4683/4684 | F173M | + |
| 4685/4686 | K249L | + |
| 4687/4688 | L163I | + |
| 4423/4424 | A275S/P291N | + |
| 4463/4464 | D237C | + |
| 4383/4384 | T300P | + |
| 4405/4406 | V309D | + |
| 4451/4452 | V309Y | + |
| 4689/4690 | S162V | + |
| 4691/4692 | K303M | + |
| 4563/4564 | M220S | + |
| 4693/4694 | I91L | + |
| 4407/4408 | I26A | + |
| 4695/4696 | D305G | + |
| 4511/4512 | K303N | + |
| 4467/4468 | S184T | + |
| 4697/4698 | I26G | + |
| 4699/4700 | D245S | + |
| 4587/4588 | K302C | + |
| 4497/4498 | I26Q | + |
| 4701/4702 | L193V | + |
| 4703/4704 | M306L | + |
| 4705/4706 | Y289V | + |
| 4379/4380 | K303G | + |
| 4543/4544 | K248R | + |
| 4707/4708 | M306W | + |
| 4709/4710 | A190C | + |
| 4373/4374 | T300M | + |
| 4711/4712 | D237L | + |
| 4539/4540 | V293I | + |
| 4713/4714 | K303A | + |
| 4715/4716 | K303R | + |
| 4717/4718 | K287R | + |
| 4377/4378 | N295L | + |
| 4569/4570 | P291R | + |
| 4719/4720 | M55V | + |
| 4535/4536 | E110N | + |
| 4721/4722 | S296C | + |
| 4723/4724 | K249G | + |
| 4503/4504 | S162A | + |
| 4725/4726 | D205E | + |
| 4409/4410 | E308L | + |
| 4727/4728 | G232N | + |
| 4415/4416 | S296R | + |
| 4729/4730 | L286C | + |
| 4473/4474 | D305S | + |
| 4731/4732 | L174E | + |
| 4397/4398 | A307S | + |
| 4399/4400 | L193G | + |
| 4537/4538 | L246I | + |
| 4491/4492 | I194L | + |

Levels of increased activity were determined relative to the reference polypeptide of SEQ ID NO: 4124 and defined as follows: "+" 1.00 to 1.27, "++" > 1.27, "+++" > 1.61

Example 86

Improvements Over SEQ ID NO: 4226 in the Extension of Oligonucleotide Acceptor Molecules with Nucleotide Triphosphate Donors HTP Screening for Improved TdT Variants SEQ ID NO: 4226 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 86.1.

Reactions were performed in 96-well format 200 μL BioRad PCR plates. Reactions included 1-4 μM oligonucleotide, 5-50 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 86.1. The quenched reactions were centrifuged at 4,000 rpm for 10 min at 4° C. to pellet any precipitate. Supernatant was then transferred into new HTP plates for analytical analysis as described in Table 86.1.

TABLE 86.1

| All lysis, purification, reaction, quench, and analytical properties |
|---|
| Lysis and purification conditions : Lysis buffer-20 mM Tris-acetate, pH 8, 0.2 g/L lysozyme from chicken egg white; Lysis buffer volume-400 μL; Lysate pre-treatment-Lysates were preincubated at 65° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide-2 μM TTTTTTTATC; Nucleotide triphosphate-25 μM 3'PO4-dATP; Reaction buffer-20 mM MOPS, pH 7.2, 0.002 Unit/μL yeast pyrophosphatase (Thermo Scientific), 50 mM potassium acetate, 250 μM cobalt (II) chloride; Reaction volume-36 μL ; Lysate dilution-64× dilution prior to adding to the reaction; Reaction temperature-65° C.; Reaction time-10 minutes |
| Quench conditions: Quench solution and volume-Reactions were quenched by adding two volumes of 90% acetonitrile and 10% methanol mixture and clarifying by centrifugation; Plate type and seal-384-well microtiter plate with seal |
| Analytical conditions: Instrument-Agilent RapidFire SPE-MS/MS-see Example 6; Reaction product detected-TTTTTTTATCA-3'PO4 |

Activity relative to SEQ ID NO: 4226 (Activity FIOP) was calculated as the product peak area of the variant compared with the product peak area observed by the reaction with SEQ ID NO: 4226 (where the peak area may be set as the average of replicates or else the highest single sample as appropriate). The results are shown in Table 86.2.

TABLE 86.2

| SEQ ID NO: (nt/aa) | Amino Acid Differences (Relative to SEQ ID NO: 4226) | FIOP Product Peak Area Relative to SEQ ID NO: 4226 |
|---|---|---|
| 4733/4734 | D103P/E111V/E235T/I321V/F324D | +++ |
| 4735/4736 | A74V/R200A/Q339M | +++ |
| 4737/4738 | Q280S | +++ |
| 4739/474O | Q32P/I321V/F324D/R360S | +++ |
| 4741/4742 | Q32P/E235T | +++ |
| 4743/4744 | E235T/Q280S | +++ |
| 4745/4746 | Q267M/N270S/A275K/Q339M/Y347F | ++ |
| 4747/4748 | Q267M/K272R/A275K | ++ |
| 4749/475O | E106R | ++ |
| 4751/4752 | E235T | ++ |
| 4753/4754 | K60R/E106R/E111V/E235T/R360S | ++ |
| 4755/4756 | E106R/E235T | ++ |
| 4757/4758 | D103P/E111V/E235T/Q280S/R360S | ++ |
| 4759/4760 | E235T/Q280S/I321V/A322T/F324D | ++ |
| 4761/4762 | Q280S/D383E | ++ |
| 4763/4764 | Q32P/D103P/E106R/E111V/A322T/F324E | ++ |
| 4765/4766 | R200A/N270S/A275K/Q339M | + |
| 4767/4768 | E106R/F324D | + |
| 4769/4770 | E111V/E235T/Q280S | + |
| 4771/4772 | E111V/A322T/R360S | + |
| 4773/4774 | E106R/E235T/D383E/Y386W | + |
| 4775/4776 | D103P/E106R/R360S | + |
| 4777/4778 | R360S/D383E | + |
| 4779/4780 | E106R/E111V | + |
| 4781/4782 | I321V/F324R | + |
| 4783/4784 | Q32P/E106R/Q280S | + |
| 4785/4786 | Q32P/F324D | + |
| 4787/4788 | E235T/Q280S/I321V/F324E/D383E/Y386W | + |
| 4789/4790 | D103P | + |
| 4791/4792 | K60R/Q280S/R360S | + |
| 4793/4794 | E106R/E111V/A322T/D383E/Y386W | + |
| 4795/4796 | Q32P/E235T/Y386W | + |
| 4797/4798 | E111V | + |

Levels of increased activity were determined relative to the reference polypeptide of SEQ ID NO: 4226 and defined as follows: "+" 1.04 to 1.26, "++" > 1.26, "+++" > 1.39

Example 87

Improvements Over SEQ ID NO: 4226 in the Extension of Oligonucleotide Acceptor Molecules with Nucleotide Triphosphate Donors HTP Screening for Improved TdT Variants SEQ ID NO: 4226 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 87.1.

Reactions were performed in 96-well format 200 μL BioRad PCR plates. Reactions included 1-4 μM oligonucleotide, 5-50 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 87.1. The quenched reactions were centrifuged at 4,000 rpm for 10 min at 4° C. to pellet any precipitate. Supernatant was then transferred into new HTP plates for analytical analysis as described in Table 87.1.

TABLE 87.1

| |
|---|
| All lysis, purification, reaction, quench, and analytical properties |
| Lysis and purification conditions : Lysis buffer-20 mM Tris-acetate, pH 8, 0.2 g/L lysozyme from chicken egg white; Lysis buffer volume-400 μL; Lysate pre-treatment-Lysates were preincubated at 60° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide-2 μM TTTTTTTACA; Nucleotide triphosphate-25 μM 3'PO4-dTTP; Reaction buffer-20 mM MOPS, pH 7.2, 0.002 Unit/μL yeast pyrophosphatase (Thermo Scientific), 50 mM potassium acetate, 250 μM cobalt (II) chloride; Reaction volume-36 μL ; Lysate dilution-128× dilution prior to adding to the reaction; Reaction temperature-60° C.; Reaction time-10 minutes |
| Quench conditions: Quench solution and volume-Reactions were quenched by adding two volumes of 90% acetonitrile and 10% methanol mixture and clarifying by centrifugation; Plate type and seal-384-well microtiter plate with seal |
| Analytical conditions: Instrument-Agilent RapidFire SPE-MS/MS-see Example 6; Reaction product detected-TTTTTTTACAT-3'PO4 |

Activity relative to SEQ ID NO: 4226 (Activity FIOP) was calculated as the product peak area of the variant compared with the product peak area observed by the reaction with SEQ ID NO: 4226 (where the peak area may be set as the average of replicates or else the highest single sample as appropriate). The results are shown in Table 87.2.

TABLE 87.2

| SEQ ID NO: (nt/aa) | Amino Acid Differences (Relative to SEQ ID NO: 4226) | FIOP Product Peak Area Relative to SEQ ID NO: 4226 |
|---|---|---|
| 4745/4746 | Q267M/N270S/A275K/Q339M/Y347F | +++ |
| 4747/4748 | Q267M/K272R/A275K | +++ |
| 4733/4734 | D103P/E111V/E235T/I321V/F324D | +++ |
| 4741/4742 | Q32P/E235T | +++ |
| 4757/4758 | D103P/E111V/E235T/Q280S/R360S | +++ |
| 4751/4752 | E235T | +++ |
| 4755/4756 | E106R/E235T | ++ |
| 4765/4766 | R200A/N270S/A275K/Q339M | ++ |
| 4799/4800 | E106R/E111V | ++ |
| 4763/4764 | Q32P/D103P/E106R/E111V/A322T/F324E | ++ |
| 4737/4738 | Q280S | ++ |
| 4773/4774 | E106R/E235T/D383E/Y386W | ++ |
| 4759/4760 | E235T/Q280S/I321V/A322T/F324D | ++ |
| 4749/475O | E106R | ++ |
| 4775/4776 | D103P/E106R/R360S | ++ |
| 4743/4744 | E235T/Q280S | ++ |
| 4797/4798 | E111V | + |
| 4777/4778 | R360S/D383E | + |
| 4769/4770 | E111V/E235T/Q280S | + |
| 4801/4802 | Q32P/A322T/F324R/D383E/Y386W | + |
| 4753/4754 | K60R/E106R/E111V/E235T/R360S | + |
| 4793/4794 | E106R/E111V/A322T/D383E/Y386W | + |
| 4781/4782 | I321V/F324R | + |
| 4789/4790 | D103P | + |
| 4767/4768 | E106R/F324D | + |
| 4739/4740 | Q32P/I321V/F324D/R360S | + |
| 4803/4804 | E106R/E111V/A322T/F324E/Y386W | + |
| 4805/4806 | K72R/A74V/R200A/K272R/Q339N/Y347F | + |
| 4761/4762 | Q280S/D383E | + |
| 4785/4786 | Q32P/F324D | + |
| 4795/4796 | Q32P/E235T/Y386W | + |
| 4771/4772 | E111V/A322T/R360S | + |

Levels of increased activity were determined relative to the reference polypeptide of SEQ ID NO: 4226 and defined as follows: "+" 1.15 to 1.29, "++" > 1.29, "+++" > 1.58

Example 88

Improvements Over SEQ ID NO: 4226 in the Extension of Oligonucleotide Acceptor Molecules with Nucleotide Triphosphate Donors HTP Screening for Improved TdT Variants SEQ ID NO: 4226 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 88.1.

Reactions were performed in 96-well format 200 µL BioRad PCR plates. Reactions included 1-4 µM oligonucleotide, 5-50 µM nucleotide triphosphate, 0.002 Unit/µL yeast pyrophosphatase (Thermo Scientific), 20 mM buffer, 50 mM potassium acetate, and 250 µM cobalt (II) chloride. The reactions were set up as follows: (i) all reaction components, except for TdT, were pre-mixed in a single solution, and 15 µL of this solution was aliquoted into each well of the 96-well plates (ii) 5 µL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 88.1. The quenched reactions were centrifuged at 4,000 rpm for 10 min at 4° C. to pellet any precipitate. Supernatant was then transferred into new HTP plates for analytical analysis as described in Table 88.1.

TABLE 88.1

| |
|---|
| All lysis, purification, reaction, quench, and analytical properties |
| Lysis and purification conditions : Lysis buffer-20 mM Tris-acetate, pH 8, 0.2 g/L lysozyme from chicken egg white; Lysis buffer volume-400 µL; Lysate pre-treatment-Lysates were preincubated at 66° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide-2 µM TTTTTTTATC; Nucleotide triphosphate-25 µM 3'PO4-dCTP; Reaction buffer-20 mM MOPS, pH 7.2, 0.002 Unit/µL yeast pyrophosphatase (Thermo Scientific), 50 mM potassium acetate, 250 µM cobalt (II) chloride; Reaction volume-20 µL ; Lysate dilution-64× dilution prior to adding to the reaction; Reaction temperature-66° C.; Reaction time-10 minutes |
| Quench conditions: Quench solution and volume-Reactions were quenched by the addition of 24 µL acetonitrile. The solutions were mixed well and then further diluted by the addition of 16 µL of 20 mM aqueous EDTA. ; Plate type and seal-96-well BioRad PCR plate with a plastic seal |
| Analytical conditions: Instrument-Agilent UHPLC 1260 prime series, Agilent Ultivo-see Example 4; Reaction product detected-TTTTTTTATCC-3'PO4 |

Activity relative to SEQ ID NO: 4226 (Activity FIOP) was calculated as the product peak area of the variant compared with the product peak area observed by the reaction with SEQ ID NO: 4226 (where the peak area may be set as the average of replicates or else the highest single sample as appropriate). The results are shown in Table 88.2.

TABLE 88.2

| SEQ ID NO: (nt/aa) | Amino Acid Differences (Relative to SEQ ID NO: 4226) | FIOP Product Peak Area Relative to SEQ ID NO: 4226 |
|---|---|---|
| 4807/4808 | S166N | +++ |
| 4809/4810 | E350I | +++ |
| 4811/4812 | A180V | +++ |
| 4813/4814 | V140I | +++ |
| 4815/4816 | E350Y | +++ |
| 4817/4818 | K141R | +++ |
| 4819/4820 | F48I | +++ |
| 4821/4822 | R360G | +++ |
| 4823/4824 | M220R | +++ |
| 4825/4826 | V244L | +++ |
| 4827/4828 | A75I | +++ |
| 4829/4830 | L69A | +++ |
| 4831/4832 | L65R | +++ |
| 4833/4834 | E350R | +++ |
| 4835/4836 | E63G | +++ |
| 4837/4838 | E349V | +++ |
| 4839/4840 | A275R | +++ |
| 4841/4842 | V135I | +++ |
| 4843/4844 | R352K | +++ |
| 4845/4846 | E256Q | ++ |
| 4847/4848 | M220Q | ++ |
| 4849/4850 | E349A | ++ |
| 4851/4852 | E349W | ++ |
| 4853/4854 | A75V | ++ |
| 4855/4856 | E349Y | ++ |
| 4857/4858 | E350V | ++ |
| 4859/4860 | L361C | ++ |
| 4861/4862 | C282M | ++ |
| 4863/4864 | C68R | ++ |
| 4865/4866 | V85I | ++ |
| 4867/4868 | L65G | ++ |
| 4869/4870 | E256G | ++ |
| 4871/4872 | S261R | ++ |
| 4873/4874 | T192L | ++ |
| 4875/4876 | A75G | ++ |
| 4877/4878 | A284C | ++ |
| 4879/4880 | S261K | ++ |
| 4881/4882 | I210V | ++ |
| 4883/4884 | S371G | ++ |
| 4885/4886 | L268I | ++ |
| 4887/4888 | E349R | ++ |
| 4889/4890 | S371M | ++ |
| 4891/4892 | C68M | ++ |
| 4893/4894 | I210L | ++ |
| 4895/4896 | K185R | ++ |
| 4897/4898 | L65N | ++ |
| 4899/4900 | A275V | ++ |
| 4901/4902 | L69T | ++ |
| 4903/4904 | A180R | + |
| 4905/4906 | V104I | + |
| 4907/4908 | I105L | + |
| 4909/4910 | R73K | + |
| 4911/4912 | S184D | + |
| 4913/4914 | L69M | + |
| 4915/4916 | E53D | + |
| 4917/4918 | K167R | + |
| 4919/4920 | T344M | + |
| 4921/4922 | I378V | + |
| 4923/4924 | T192Q | + |
| 4925/4926 | S371K | + |
| 4927/4928 | M220I | + |
| 4929/4930 | R360Q | + |
| 4931/4932 | L239V | + |
| 4933/4934 | E57L | + |
| 4935/4936 | A180G | + |
| 4937/4938 | S371V | + |
| 4939/4940 | G266R | + |
| 4941/4942 | N58D | + |
| 4943/4944 | E325S | + |
| 4945/4946 | T344I | + |
| 4947/4948 | D274W | + |
| 4949/4950 | K185F | + |
| 4951/4952 | A275K | + |
| 4953/4954 | S261A | + |
| 4955/4956 | L65W | + |
| 4957/4958 | E63D | + |

TABLE 88.2-continued

| SEQ ID NO: (nt/aa) | Amino Acid Differences (Relative to SEQ ID NO: 4226) | FIOP Product Peak Area Relative to SEQ ID NO: 4226 |
|---|---|---|
| 4959/4960 | D50E | + |
| 4961/4962 | L69H | + |
| 4963/4964 | P273G | + |
| 4965/4966 | I210T | + |
| 4967/4968 | E265K/R346M | + |
| 4969/4970 | Y386F | + |
| 4971/4972 | D123N | + |
| 4973/4974 | L94V | + |
| 4975/4976 | E187D | + |
| 4977/4978 | L253I | + |
| 4979/4980 | A284S | + |
| 4981/4982 | G217R | + |
| 4983/4984 | D353C | + |
| 4985/4986 | S371T | + |
| 4987/4988 | Q267K | + |
| 4989/4990 | E349H | + |
| 4991/4992 | T209A | + |
| 4993/4994 | E260N | + |
| 4995/4996 | K365Q | + |
| 4997/4998 | L65V | + |

Levels of increased activity were determined relative to the reference polypeptide of SEQ ID NO: 4226 and defined as follows: "+" 1.00 to 1.38, "++" > 1.38, "+++" > 1.76

Example 89

Improvements Over SEQ ID NO: 4226 in the Extension of Oligonucleotide Acceptor Molecules with Nucleotide Triphosphate Donors HTP Screening for Improved TdT Variants SEQ ID NO: 4226 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 89.1.

Reactions were performed in 96-well format 200 μL BioRad PCR plates. Reactions included 1-4 μM oligonucleotide, 5-50 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 89.1. The quenched reactions were centrifuged at 4,000 rpm for 10 min at 4° C. to pellet any precipitate. Supernatant was then transferred into new HTP plates for analytical analysis as described in Table 89.1.

TABLE 89.1

All lysis, purification, reaction, quench, and analytical properties
Lysis and purification conditions : Lysis buffer-20 mM Tris-acetate, pH 8, 0.2 g/L lysozyme from chicken egg white; Lysis buffer volume-400 μL; Lysate pre-treatment-Lysates were preincubated at 60° C. for one hour, then centrifuged at 4,000 rpm for 10 min as described in Example 2 [Lysis of HTP Cell Pellets with Lysozyme]. The clarified supernatants TABLE 89.1-continued were used in reactions.
Reaction conditions: Oligonucleotide-2 μM TTTTTTTCCA; Nucleotide triphosphate-25 μM 3'PO4-dTTP; Reaction buffer-20 mM MOPS, pH 7.2, 0.002 Unit/μL yeast pyrophosphatase (Thermo Scientific), 50 mM potassium acetate, 250 μM cobalt (II) chloride; Reaction volume-20 μL ; Lysate dilution-32× dilution prior to adding to the reaction; Reaction temperature-60° C.; Reaction time-10 minutes
Quench conditions: Quench solution and volume-Reactions were quenched by the addition of 24 μL acetonitrile. The solutions were mixed well and then further diluted by the addition of 16 μL of 20 mM aqueous EDTA. ; Plate type and seal-96-well BioRad PCR plate with a plastic seal
Analytical conditions: Instrument-Agilent UHPLC 1260 prime series, Agilent Ultivo-see Example 4; Reaction product detected-TTTTTTTCCAT-3'PO4

Activity relative to SEQ ID NO: 4226 (Activity FIOP) was calculated as the product peak area of the variant compared with the product peak area observed by the reaction with SEQ ID NO: 4226 (where the peak area may be set as the average of replicates or else the highest single sample as appropriate). The results are shown in Table 89.2.

TABLE 89.2

| SEQ ID NO: (nt/aa) | Amino Acid Differences (Relative to SEQ ID NO: 4226) | FIOP Product Peak Area Relative to SEQ ID NO: 4226 |
|---|---|---|
| 4811/4812 | A180V | +++ |
| 4827/4828 | A75I | +++ |
| 4817/4818 | K141R | +++ |
| 4809/4810 | E350I | +++ |
| 4999/5000 | L384V | +++ |
| 4813/4814 | VI401 | +++ |
| 5001/5002 | E70R | +++ |
| 4847/4848 | M220Q | +++ |
| 4931/4932 | L239V | +++ |
| 4863/4864 | C68R | +++ |
| 4873/4874 | T192L | +++ |
| 4807/4808 | S166N | +++ |
| 4951/4952 | A275K | +++ |
| 4875/4876 | A75G | +++ |
| 4833/4834 | E350R | +++ |
| 4819/4820 | F48I | +++ |
| 4853/4854 | A75V | +++ |
| 4829/4830 | L69A | +++ |
| 4825/4826 | V244L | +++ |
| 4815/4816 | E350Y | +++ |
| 4831/4832 | L65R | ++ |
| 4839/4840 | A275R | ++ |
| 4823/4824 | M220R | ++ |
| 5003/5004 | E70K | ++ |
| 4969/4970 | Y386F | ++ |
| 4903/4904 | A180R | ++ |
| 4921/4922 | I378V | ++ |
| 4841/4842 | V135I | ++ |
| 4909/4910 | R73K | ++ |
| 5005/5006 | N358A | ++ |
| 4901/4902 | L69T | ++ |
| 4949/4950 | K185F | ++ |
| 5007/5008 | C68V | ++ |
| 5009/5010 | L69G | ++ |
| 4871/4872 | S261R | ++ |
| 4867/4868 | L65G | ++ |
| 5011/5012 | A56V | ++ |
| 4857/4858 | E350V | ++ |
| 5013/5014 | E350C | ++ |
| 4861/4862 | C282M | ++ |
| 4821/4822 | R360G | ++ |
| 4943/4944 | E325S | ++ |
| 4885/4886 | L268I | ++ |
| 4945/4946 | T344I | ++ |

TABLE 89.2-continued

| SEQ ID NO: (nt/aa) | Amino Acid Differences (Relative to SEQ ID NO: 4226) | FIOP Product Peak Area Relative to SEQ ID NO: 4226 |
|---|---|---|
| 5015/5016 | R360K | ++ |
| 4851/4852 | E349W | ++ |
| 4925/4926 | S371K | ++ |
| 5017/5018 | C68Q | ++ |
| 4855/4856 | E349Y | ++ |
| 4939/4940 | G266R | ++ |
| 5019/5020 | Y175H | ++ |
| 4935/4936 | A180G | + |
| 4879/4880 | S261K | + |
| 5021/5022 | A75M | + |
| 5023/5024 | D274G | + |
| 4837/4838 | E349V | + |
| 4835/4836 | E63G | + |
| 4897/4898 | L65N | + |
| 4941/4942 | N58D | + |
| 4907/4908 | I105L | + |
| 4877/4878 | A284C | + |
| 5025/5026 | A330T | + |
| 4845/4846 | E256Q | + |
| 4961/4962 | L69H | + |
| 4893/4894 | I210L | + |
| 4975/4976 | E187D | + |
| 4915/4916 | E53D | + |
| 4981/4982 | G217R | + |
| 4843/4844 | R352K | + |
| 5027/5028 | L65A | + |
| 4917/4918 | K167R | + |
| 4895/4896 | K185R | + |
| 4891/4892 | C68M | + |
| 4979/4980 | A284S | + |
| 4953/4954 | S261A | + |
| 4859/4860 | L361C | + |
| 4923/4924 | T192Q | + |
| 4899/4900 | A275V | + |
| 4869/4870 | E256G | + |
| 5029/5030 | Y176H | + |
| 4937/4938 | S371V | + |
| 4881/4882 | I210V | + |
| 5031/5032 | E256S | + |
| 4849/4850 | E349A | + |
| 4957/4958 | E63D | + |
| 5033/5034 | S261H | + |
| 4933/4934 | E57L | + |
| 5035/5036 | R346K | + |
| 5037/5038 | E70N | + |
| 5039/5040 | P271R | + |
| 4913/4914 | L69M | + |
| 4927/4928 | M220I | + |
| 4959/4960 | D50E | + |
| 4929/4930 | R360Q | + |
| 4997/4998 | L65V | + |
| 4993/4994 | E260N | + |
| 5041/5042 | F48L | + |
| 4883/4884 | S371G | + |
| 5043/5044 | K185M | + |
| 4887/4888 | E349R | + |
| 5045/5046 | F369L | + |
| 5047/5048 | Q280G | + |

Levels of increased activity were determined relative to the reference polypeptide of SEQ ID NO: 4226 and defined as follows: "+" 1.00 to 1.34, "++" > 1.34, "+++" > 1.71

Example 90

Improvements Over SEQ ID NO: 4734 in the Extension of Oligonucleotide Acceptor Molecules with Nucleotide Triphosphate Donors HTP Screening for Improved TdT Variants SEQ ID NO: 4734 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 90.1.

Reactions were performed in 96-well format 200 μL BioRad PCR plates. Reactions included 1-4 μM oligonucleotide, 5-50 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 90.1. The quenched reactions were centrifuged at 4,000 rpm for 10 min at 4° C. to pellet any precipitate. Supernatant was then transferred into new HTP plates for analytical analysis as described in Table 90.1.

TABLE 90.1

| |
|---|
| All lysis, purification, reaction, quench, and analytical properties |
| Lysis and purification conditions : Lysis buffer-20 mM Tris-acetate, pH 8, 0.2 g/L lysozyme from chicken egg white; Lysis buffer volume-400 μL; Lysate pre-treatment-Lysates were preincubated at 66° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide-2 μM TTTTTTTATC; Nucleotide triphosphate-25 μM 3'PO4-dATP; Reaction buffer-20 mM MOPS, pH 7.2, 0.002 Unit/μL yeast pyrophosphatase (Thermo Scientific), 50 mM potassium acetate, 250 μM cobalt (II) chloride; Reaction volume-36 μL ; Lysate dilution-64× dilution prior to adding to the reaction; Reaction temperature-66° C.; Reaction time-5 minutes |
| Quench conditions: Quench solution and volume-Reactions were quenched by adding two volumes of 90% acetonitrile and 10% methanol mixture and clarifying by centrifugation; Plate type and seal-384-well microtiter plate with seal |
| Analytical conditions: Instrument-Agilent RapidFire SPE-MS/MS-see Example 6; Reaction product detected-TTTTTTTATCA-3'PO4 |

Activity relative to SEQ ID NO: 4734 (Activity FIOP) was calculated as the product peak area of the variant compared with the product peak area observed by the reaction with SEQ ID NO: 4734 (where the peak area may be set as the average of replicates or else the highest single sample as appropriate). The results are shown in Table 90.2.

TABLE 90.2

| SEQ ID NO: (nt/aa) | Amino Acid Differences (Relative to SEQ ID NO: 4734) | FIOP Product Peak Area Relative to SEQ ID NO: 4734 |
|---|---|---|
| 5049/5050 | Q32P/S162F/D237P/E265P/G266Q | +++ |
| 5051/5052 | V154R/S166N | +++ |
| 5053/5054 | S162R/D237P/E265P/G266Q/Q267M/K302L | +++ |
| 5055/5056 | S166N/I210L | +++ |
| 5057/5058 | Q32P/K302L | +++ |
| 5059/5060 | E53T/L163M/T201R/E325H/Y329F | +++ |
| 5061/5062 | S166N/S296R | +++ |
| 5063/5064 | Q32P/K161R/L193A/D237P/R360S | ++ |

TABLE 90.2-continued

| SEQ ID NO: (nt/aa) | Amino Acid Differences (Relative to SEQ ID NO: 4734) | FIOP Product Peak Area Relative to SEQ ID NO: 4734 |
|---|---|---|
| 5065/5066 | S371R | ++ |
| 5067/5068 | V154R/Q339M | ++ |
| 5069/5070 | S162F/L193A/G232N/ Q267M/K302L/R360S | ++ |
| 5071/5072 | T201R/S371R | ++ |
| 5073/5074 | S166N/R346W/Y347F | ++ |
| 5075/5076 | V154R/S166T/I210L/S296R | ++ |
| 5077/5078 | S162F/Q267M/R360S | ++ |
| 5079/5080 | Q32P | ++ |
| 5081/5082 | I210L/Q339M | ++ |
| 5083/5084 | E53T/T201R | ++ |
| 5085/5086 | K161G/S162F | + |
| 5087/5088 | D237P/E265P | + |
| 5089/5090 | Q32P/S162F/K302L | + |
| 5091/5092 | V154R | + |
| 5093/5094 | Q32P/S162F/L193A/Q267M | + |
| 5095/5096 | S162R | + |
| 5097/5098 | K161R/S162F | + |
| 5099/5100 | Q339M | + |
| 5101/5102 | S162F/E265P | + |
| 5103/5104 | D237P/G266Q/R360S | + |
| 5105/5106 | E53T/R200A/T201R/E325H/Y329F | + |
| 5107/5108 | D237P | + |
| 5109/5110 | E156V/I210L/Q339M | + |
| 5111/5112 | D237P/R360S | + |
| 5113/5114 | K161G/D237P | + |
| 5115/5116 | L193A/Q267M | + |
| 5117/5118 | E53T/T201R/A275K/Q280S | + |
| 5119/5120 | K167R/I210L/R346W/E349S | + |
| 5121/5122 | Q32P/S162F | + |

Levels of increased activity were determined relative to the reference polypeptide of SEQ ID NO: 4734 and defined as follows: "+" 1.11 to 1.28, "++" > 1.28, "+++" > 1.43

Example 91

Improvements Over SEQ ID NO: 4734 in the Extension of Oligonucleotide Acceptor Molecules with Nucleotide Triphosphate Donors

HTP Screening for Improved TdT Variants

SEQ ID NO: 4734 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 91.1.

Reactions were performed in 96-well format 200 μL BioRad PCR plates. Reactions included 1-4 μM oligonucleotide, 5-50 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 91.1. The quenched reactions were centrifuged at 4,000 rpm for 10 min at 4° C. to pellet any precipitate. Supernatant was then transferred into new HTP plates for analytical analysis as described in Table 91.1.

TABLE 91.1

| |
|---|
| All lysis, purification, reaction, quench, and analytical properties |
| Lysis and purification conditions : Lysis buffer-20 mM Tris-acetate, pH 8, 0.2 g/L lysozyme from chicken egg white; Lysis buffer volume-400 μL; Lysate pre-treatment-Lysates were preincubated at 60° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide-2 μM TTTTTTTGTT; Nucleotide triphosphate-5 μM 3'PO4-dTTP; Reaction buffer-20 mM MOPS, pH 7.2, 0.002 Unit/μL yeast pyrophosphatase (Thermo Scientific), 50 mM potassium acetate, 250 μM cobalt (II) chloride; Reaction volume-36 μL ; Lysate dilution-32× dilution prior to adding to the reaction; Reaction temperature-60° C.; Reaction time-5 minutes |
| Quench conditions: Quench solution and volume-Reactions were quenched by adding two volumes of 90% acetonitrile and 10% methanol mixture and clarifying by centrifugation; Plate type and seal-384-well microtiter plate with seal |
| Analytical conditions: Instrument-Agilent RapidFire SPE-MS/MS-see Example 6; Reaction product detected-TTTTTTTGTTT-3'PO4 |

Activity relative to SEQ ID NO: 4734 (Activity FIOP) was calculated as the product peak area of the variant compared with the product peak area observed by the reaction with SEQ ID NO: 4734 (where the peak area may be set as the average of replicates or else the highest single sample as appropriate). The results are shown in Table 91.2.

TABLE 91.2

| SEQ ID NO: (nt/aa) | Amino Acid Differences (Relative to SEQ ID NO: 4734) | FIOP Product Peak Area Relative to SEQ ID NO: 4734 |
|---|---|---|
| 5051/5052 | V154R/S166N | +++ |
| 5083/5084 | E53T/T201R | +++ |
| 5117/5118 | E53T/T201R/A275K/Q280S | +++ |
| 5067/5068 | V154R/Q339M | +++ |
| 5105/5106 | E53T/R200A/T201R/E325H/Y329F | +++ |
| 5123/5124 | S162R/D237P/E265P/G266Q/Q267M/K302L | +++ |
| 5055/5056 | S166N/I210L | +++ |
| 5069/5070 | S162F/L193A/G232N/Q267M/K302L/R360S | +++ |
| 5087/5088 | D237P/E265P | ++ |
| 5101/5102 | S162F/E265P | ++ |
| 5125/5126 | E53T/T201R/S371R | ++ |
| 5127/5128 | V154R/S166N/Y347F | ++ |
| 5081/5082 | I210L/Q339M | ++ |
| 5107/5108 | D237P | ++ |
| 5121/5122 | Q32P/S162F | ++ |
| 5073/5074 | S166N/R346W/Y347F | ++ |
| 5049/5050 | Q32P/S162F/D237P/E265P/G266Q | ++ |
| 5129/5130 | Q32P | ++ |
| 5059/5060 | E53T/L163M/T201R/E325H/Y329F | ++ |
| 5131/5132 | V154R/K167R/I210L/Y347F/E349S | ++ |
| 5075/5076 | V154R/S166T/I210L/S296R | + |
| 5099/5100 | Q339M | + |
| 5093/5094 | Q32P/S162F/L193 A/Q267M | + |
| 5089/5090 | Q32P/S162F/K302L | + |
| 5071/5072 | T201R/S371R | + |
| 5113/5114 | K161G/D237P | + |
| 5061/5062 | S166N/S296R | + |
| 5133/5134 | L163M/T201R | + |
| 5135/5136 | P82S/V154R/S296R | + |
| 5137/5138 | V154R/S166N/R346S/Y347F | + |
| 5139/5140 | V154R | + |
| 5141/5142 | V154R/S296R/Y347F | + |
| 5097/5098 | K161R/S162F | + |
| 5143/5144 | E156V/S166T/K167R | + |
| 5077/5078 | S162F/Q267M/R360S | + |

TABLE 91.2-continued

| SEQ ID NO: (nt/aa) | Amino Acid Differences (Relative to SEQ ID NO: 4734) | FIOP Product Peak Area Relative to SEQ ID NO: 4734 |
|---|---|---|
| 5115/5116 | L193A/Q267M | + |
| 5145/5146 | V154R/Y347F | + |
| 5147/5148 | K164M/A275K/Q280S | + |
| 5095/5096 | S162R | + |
| 5149/5150 | Q32P/S162R/L193A | + |

Levels of increased activity were determined relative to the reference polypeptide of SEQ ID NO: 4734 and defined as follows: "+" 1.20 to 1.37, "++" > 1.37, "+++" > 1.56

Example 92

Improvements Over SEQ ID NO: 5052 in the Extension of Oligonucleotide Acceptor Molecules with Nucleotide Triphosphate Donors HTP Screening for Improved TdT Variants SEQ ID NO: 5052 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 92.1.

Reactions were performed in 96-well format 200 μL BioRad PCR plates. Reactions included 1-4 μM oligonucleotide, 5-50 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 92.1. The quenched reactions were centrifuged at 4,000 rpm for 10 min at 4° C. to pellet any precipitate. Supernatant was then transferred into new HTP plates for analytical analysis as described in Table 92.1.

TABLE 92.1

| All lysis, purification, reaction, quench, and analytical properties |
|---|
| Lysis and purification conditions : Lysis buffer - 20mM Tris-acetate, pH 8, 0.2 g/L lysozyme from chicken egg white; Lysis buffer volume - 400 μL; Lysate pre-treatment - Lysates were preincubated at 60° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide - 2 μM TTTTTTTCGT; Nucleotide triphosphate - 15 pM 3PO4-dTTP; Reaction buffer - 20 mM MOPS, pH 7.2, 0.002 Unit/pL yeast pyrophosphatase (Thermo Scientific), 50 mM potassium acetate, 250 pM cobalt (II) chloride; Reaction volume - 36 μL ; Lysate dilution - 32× dilution prior to adding to the reaction; Reaction temperature - 60° C.; |
| Reaction time - 5 minutes |
| Quench conditions: Quench solution and volume - Reactions were quenched by adding two volumes of 90% acetonitrile and 10% methanol mixture and clarifying by centrifugation; Plate type and seal - 384-well microtiter plate with seal |
| Analytical conditions: Instrument - Agilent RapidFire SPE-MS/MS - see Example 6; Reaction product detected - TTTTTTTCGTT-3'PO4 |

Activity relative to SEQ ID NO: 5052 (Activity FIOP) was calculated as the product peak area of the variant compared with the product peak area observed by the reaction with SEQ ID NO: 5052 (where the peak area may be set as the average of replicates or else the highest single sample as appropriate). The results are shown in Table 92.2.

TABLE 92.2

| SEQ ID NO: (nt/aa) | Amino Acid Differences (Relative to SEQ ID NO: 5052) | FIOP Product Peak Area Relative to SEQ ID NO: 5052 |
|---|---|---|
| 5151/5152 | Q32P/K72R/Q339M/R360G | +++ |
| 5153/5154 | M220R/Q339M | +++ |
| 5155/5156 | S261R | +++ |
| 5157/5158 | E70R/R360S | +++ |
| 5159/5160 | E155Y/M220R/E325S/Q339M | +++ |
| 5161/5162 | Q32P/A180R/S261R/Q339M | +++ |
| 5163/5164 | K141R/V244L/R360S | ++ |
| 5165/5166 | M220R | ++ |
| 5167/5168 | E256Q/R360S | ++ |
| 5169/5170 | L69A/M220R | ++ |
| 5171/5172 | A180R/Q339M | ++ |
| 5173/5174 | K141R/S261R/Q339M | ++ |
| 5175/5176 | E53T/R73K/A75V/D237P/L239V | ++ |
| 5177/5178 | E70R | ++ |
| 5179/5180 | Q32P/V1401/Q339M | ++ |
| 5181/5182 | E70R/V1401/K141R/Q339M | ++ |
| 5183/5184 | K72R/R360G | + |
| 5185/5186 | K141R/R360S | + |
| 5187/5188 | L69A/Q339M | + |
| 5189/5190 | A751/D237P/E350R | + |
| 5191/5192 | V1401/K141R/E256Q/S261R/Q339M | + |
| 5193/5194 | Q32P/Q339M | + |
| 5195/5196 | Q32P/V140PK141R/S261R/R360S | + |
| 5197/5198 | V1401/A180R/V244L/S261R/Q339M/R360G | + |
| 5199/5200 | Q32P | + |
| 5201/5202 | Q32P/V1401/R360G | + |
| 5203/5204 | E70R/K72R/A180R/R360G | + |
| 5205/5206 | Q32P/V244L/S261R | + |
| 5207/5208 | Q32P/K72R/Q339M | + |
| 5209/5210 | K141R/E256Q/Q339M/R360G | + |
| 5211/5212 | K72R/E256Q/R360S | + |
| 5213/5214 | K141R/V244L/S261R/R360S | + |
| 5215/5216 | Q32P/K141R/A180R/V244L | + |

Levels of increased activity were determined relative to the reference polypeptide of SEQ ID NO: 5052 and defined as follows: "+" 1.20 to 1.47, "++" > 1.47, "+++" > 1.69

Example 93

Improvements Over SEQ ID NO: 5052 in the Extension of Oligonucleotide Acceptor Molecules with Nucleotide Triphosphate Donors HTP Screening for Improved TdT Variants SEQ ID NO: 5052 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 93.1.

Reactions were performed in 96-well format 200 µL BioRad PCR plates. Reactions included 1-4 µM oligonucleotide, 5-50 µM nucleotide triphosphate, 0.002 Unit/µL yeast pyrophosphatase (Thermo Scientific), 20 mM buffer, 50 mM potassium acetate, and 250 µM cobalt (II) chloride. The reactions were set up as follows: (i) all reaction components, except for TdT, were pre-mixed in a single solution, and 15 µL of this solution was aliquoted into each well of the 96-well plates (ii) 5 µL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 93.1. The quenched reactions were centrifuged at 4,000 rpm for 10 min at 4° C. to pellet any precipitate. Supernatant was then transferred into new HTP plates for analytical analysis as described in Table 93.1.

TABLE 93.1

| All lysis, purification, reaction, quench, and analytical properties |
|---|
| Lysis and purification conditions : Lysis buffer - 20 mM Tris-acetate, pH 8, 0.2 g/L lysozyme from chicken egg white; Lysis buffer volume - 400 µL; Lysate pre-treatment - Lysates were preincubated at 69° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide - 2 µM TTTTTTTATC; Nucleotide triphosphate - 15 µM 3'P04-dATP; Reaction buffer - 20 mM MOPS, pH 7.2, 0.002 Unit/pL yeast pyrophosphatase (Thermo Scientific), 50 mM potassium acetate, 250 µM cobalt (II) chloride; Reaction volume - 36 µL ; Lysate dilution - 16× dilution prior to adding to the reaction; Reaction temperature - 69° C.; Reaction time - 5 minutes |
| Quench conditions: Quench solution and volume - Reactions were quenched by adding two volumes of 90% acetonitrile and 10% methanol mixture and clarifying by centrifugation; Plate type and seal - 384-well microtiter plate with seal |
| Analytical conditions: Instrument - Agilent RapidFire SPE-MS/MS - see Example 6; Reaction product detected - TTTTTTTATCA-3'PO4 |

Activity relative to SEQ ID NO: 5052 (Activity FIOP) was calculated as the product peak area of the variant compared with the product peak area observed by the reaction with SEQ ID NO: 5052 (where the peak area may be set as the average of replicates or else the highest single sample as appropriate). The results are shown in Table 93.2.

TABLE 93.2

| SEQ ID NO: (nt/aa) | Amino Acid Differences (Relative to SEQ ID NO: 5052) | FIOP Product Peak Area Relative to SEQ ID NO: 5052 |
|---|---|---|
| 5217/5218 | V244L/E256Q/S261R/Q339M/R360S | +++ |
| 5151/5152 | Q32P/K72R/Q339M/R360G | +++ |
| 5153/5154 | M220R/Q339M | +++ |
| 5197/5198 | V140I/A180R/V244L/S261R/Q339M/R360G | +++ |
| 5207/5208 | Q32P/K72R/Q339M | +++ |
| 5219/5220 | E325S/Q339M | +++ |
| 5221/5222 | Q32P/Q339M | +++ |
| 5173/5174 | K141R/S261R/Q339M | ++ |
| 5179/5180 | Q32P/V1401/Q339M | ++ |
| 5165/5166 | M220R | ++ |
| 5161/5162 | Q32P/A180R/S261R/Q339M | ++ |
| 5223/5224 | Q339M | ++ |
| 5175/5176 | E53T/R73K/A75V/D237P/L239V | ++ |
| 5187/5188 | L69A/Q339M | ++ |
| 5159/5160 | E155Y/M220R/E325S/Q339M | ++ |
| 5191/5192 | V1401/K141R/E256Q/S261R/Q339M | ++ |
| 5163/5164 | K141R/V244L/R360S | ++ |
| 5225/5226 | E325S | ++ |
| 5169/5170 | L69A/M220R | + |
| 5227/5228 | E70R/S261R/Q339M/R360S | + |
| 5229/5230 | L65R/M220Q/Q339M | + |
| 5209/5210 | K141R/E256Q/Q339M/R360G | + |
| 5231/5232 | A56V/A75V/T192L/L239V | + |
| 5195/5196 | Q32P/V1401/K141R/S261R/R360S | + |
| 5233/5234 | E70R/K72R | + |

TABLE 93.2-continued

| SEQ ID NO: (nt/aa) | Amino Acid Differences (Relative to SEQ ID NO: 5052) | FIOP Product Peak Area Relative to SEQ ID NO: 5052 |
|---|---|---|
| 5235/5236 | G150D/V244L/S261R/R360S | + |
| 5237/5238 | E70R/K72R/V1401/V244L/S261R/Q339M | + |
| 5183/5184 | K72R/R360G | + |
| 5185/5186 | K141R/R360S | + |
| 5205/5206 | Q32P/V244L/S261R | + |
| 5239/5240 | A56V/A75I/R154V/E156V/T192L/ L239V/Q280G/C282M | + |
| 5241/5242 | A56V/T192Q/C282M/E350I | + |
| 5243/5244 | A180R/Q339M | + |
| 5245/5246 | R154V/E156V/C282M/E350I | + |
| 5247/5248 | E70R/K72R/K141R/V244L | + |
| 5211/5212 | K72R/E256Q/R360S | + |
| 5249/5250 | K72R/A180R/V244L/Q339M | + |

Levels of increased activity were determined relative to the reference polypeptide of SEQ ID NO: 5052 and defined as follows: "+" 1.20 to 1.94, "++" > 1.94, "+++" > 3.79

Example 94

Improvements Over SEQ ID NO: 5152 in the Extension of Oligonucleotide Acceptor Molecules with Nucleotide Triphosphate Donors HTP Screening for Improved TdT Variants SEQ ID NO: 5152 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 94.1.

Reactions were performed in 96-well format 200 μL BioRad PCR plates. Reactions included 1-4 μM oligonucleotide, 5-50 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 94.1. The quenched reactions were centrifuged at 4,000 rpm for 10 min at 4° C. to pellet any precipitate. Supernatant was then transferred into new HTP plates for analytical analysis as described in Table 94.1.

TABLE 94.1

| All lysis, purification, reaction, quench, and analytical properties |
|---|
| Lysis and purification conditions : Lysis buffer - 20 mM Tris-acetate, pH 8, 0.2 g/L lysozyme from chicken egg white; Lysis buffer volume - 400 μL; Lysate pre-treatment - Lysates were preincubated at 60° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide - 2 pM TTTTTTTCGA; Nucleotide triphosphate - 15 pM 3'PO4-dTTP; Reaction buffer - 20 mM MOPS, pH 7.2, 0.002 Unit/pL yeast pyrophosphatase (Thermo Scientific), 50 mM potassium acetate, 250 μM cobalt (II) chloride; Reaction volume - 36 μL ; Lysate dilution - 32× dilution prior to adding to the reaction; Reaction temperature - 60° C.; Reaction time - 5 minutes |
| Quench conditions: Quench solution and volume - Reactions were quenched by adding two volumes of 90% acetonitrile and 10% methanol mixture and clarifying by centrifugation; Plate type and seal - 384-well microtiter plate with seal |
| Analytical conditions: Instrument - Agilent RapidFire SPE-MS/MS - see Example 6; Reaction product detected - TTTTTTTCGAT-3'PO4 |

Activity relative to SEQ ID NO: 5152 (Activity FIOP) was calculated as the product peak area of the variant compared with the product peak area observed by the reaction with SEQ ID NO: 5152 (where the peak area may be set as the average of replicates or else the highest single sample as appropriate). The results are shown in Table 94.2.

TABLE 94.2

| SEQ ID NO: (nt/aa) | Amino Acid Differences (Relative to SEQ ID NO: 5152) | FIOP Product Peak Area Relative to SEQ ID NO: 5152 |
|---|---|---|
| 5251/5252 | T192L/L193D | +++ |
| 5253/5254 | E53T/D237P | +++ |
| 5255/5256 | L65R/V140I/T192L/L193D/K302L | ++ |
| 5257/5258 | K302L | ++ |
| 5259/5260 | A180 V | ++ |
| 5261/5262 | L239V | + |
| 5263/5264 | V140I/T192L/L193D/K302L | ++ |
| 5265/5266 | V140I/L193D/K302L | + |
| 5267/5268 | E53T | + |
| 5269/5270 | L65R/V140I/T192L/L193D | + |
| 5271/5272 | L65R/V140I | + |
| 5273/5274 | L65R/L193D | + |

Levels of increased activity were determined relative to the reference polypeptide of SEQ ID NO: 5152 and defined as follows: "+" 1.06 to 1.20, "++" > 1.20, "+++" > 1.28

Example 95

Improvements Over SEQ ID NO: 5252 in the Extension of Oligonucleotide Acceptor Molecules with Nucleotide Triphosphate Donors HTP Screening for Improved TdT Variants SEQ ID NO: 5252 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 95.1.

Reactions were performed in 96-well format 200 µL BioRad PCR plates. Reactions included 1-4 µM oligonucleotide, 5-50 µM nucleotide triphosphate, 0.002 Unit/µL yeast pyrophosphatase (Thermo Scientific), 20 mM buffer, 50 mM potassium acetate, and 250 µM cobalt (II) chloride. The reactions were set up as follows: (i) all reaction components, except for TdT, were pre-mixed in a single solution, and 15 µL of this solution was aliquoted into each well of the 96-well plates (ii) 5 µL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 95.1. The quenched reactions were centrifuged at 4,000 rpm for 10 min at 4° C. to pellet any precipitate. Supernatant was then transferred into new HTP plates for analytical analysis as described in Table 95.1.

TABLE 95

| All lysis, purification, reaction, quench, and analytical properties |
|---|
| Lysis and purification conditions : Lysis buffer - 20 mM Tris-acetate, pH 8, 0.2 g/L lysozyme from chicken egg white; Lysis buffer volume - 400 µL; Lysate pre-treatment - Lysates were preincubated at 70° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide - 2 µM TTTTTTTATC; Nucleotide triphosphate - 10 pM 3PO4-dATP; Reaction buffer - 20 mM MOPS, pH 7.2, 0.002 Unit/pL yeast pyrophosphatase (Thermo Scientific), 50 mM potassium acetate, 250 pM cobalt (II) chloride; Reaction volume - 36 µL ; Lysate dilution - 16× dilution prior to adding to the reaction; Reaction temperature - 70° C.; Reaction time - 2 minutes |
| Quench conditions: Quench solution and volume - Reactions were quenched by adding two volumes of 90% acetonitrile and 10% methanol mixture and clarifying by centrifugation; Plate type and seal - 384-well microtiter plate with seal |
| Analytical conditions: Instrument - Agilent RapidFire SPE-MS/MS - see Example 6; Reaction product detected - TTTTTTTATCA-3'PO4 |

Activity relative to SEQ ID NO: 5252 (Activity FIOP) was calculated as the product peak area of the variant compared with the product peak area observed by the reaction with SEQ ID NO: 5252 (where the peak area may be set as the average of replicates or else the highest single sample as appropriate). The results are shown in Table 95.2.

TABLE 95.2

| SEQ ID NO: (nt/aa) | Amino Acid Differences (Relative to SEQ ID NO: 5252) | FIOP Product Peak Area Relative to SEQ ID NO: 5252 |
|---|---|---|
| 5275/5276 | S261R | +++ |
| 5277/5278 | S162F | +++ |
| 5279/5280 | F48I/E256G/S261R | ++ |
| 5281/5282 | K141R/S261R | ++ |
| 5283/5284 | K302L | ++ |
| 5285/5286 | M220Q | + |
| 5287/5288 | VI401 | + |
| 5289/5290 | M220Q/E349V | + |
| 5291/5292 | E350Y | + |
| 5293/5294 | F48I/E53T/D237P/L239V | + |

Levels of increased activity were determined relative to the reference polypeptide of SEQ ID NO: 5252 and defined as follows: "+" 1.11 to 1.49, "++" > 1.49, "+++" > 3.00

Example 96

Improvements Over SEQ ID NO: 5296 in the Extension of Oligonucleotide Acceptor Molecules with Nucleotide Triphosphate Donors HTP Screening for Improved TdT Variants SEQ ID NO: 5296 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 96.1.

Reactions were performed in 96-well format 200 µL BioRad PCR plates. Reactions included 1-4 µM oligonucleotide, 5-50 µM nucleotide triphosphate, 0.002 Unit/µL yeast pyrophosphatase (Thermo Scientific), 20 mM buffer, 50 mM potassium acetate, and 250 µM cobalt (II) chloride. The reactions were set up as follows: (i) all reaction components, except for TdT, were pre-mixed in a single solution, and 15 µL of this solution was aliquoted into each well of the 96-well plates (ii) 5 µL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 96.1. The quenched reactions were centrifuged at 4,000 rpm for 10 min at 4° C. to pellet any precipitate. Supernatant was then transferred into new HTP plates for analytical analysis as described in Table 96.1.

TABLE 96.1

| All lysis, purification, reaction, quench, and analytical properties |
|---|
| Lysis and purification conditions : Lysis buffer - 20 mM Tris-acetate, pH 8, 0.2 g/L lysozyme from chicken egg white; Lysis buffer volume - 400 µL; Lysate pre-treatment - Lysates were preincubated at 60° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide - 1 µM TTTTTTTGTT; Nucleotide triphosphate - 5 µM 3PO4-dTTP; Reaction buffer - 20 mM MOPS, pH 7.2, 0.002 Unit/pL yeast pyrophosphatase (Thermo Scientific), 50 mM potassium acetate, 250 pM cobalt (II) chloride; Reaction volume - 36 pL ; Lysate dilution - 16× dilution prior to adding to the reaction; Reaction temperature - 60° C.; Reaction time - 2 minutes |
| Quench conditions: Quench solution and volume - Reactions were quenched by adding two volumes of 90% acetonitrile and 10% methanol mixture and clarifying by centrifugation; Plate type and seal - 384-well microtiter plate with seal |
| Analytical conditions: Instrument - Agilent RapidFire SPE-MS/MS - see Example 6; Reaction product detected - TTTTTTTGTTT-3'PO4 |

Activity relative to SEQ ID NO: 5296 (Activity FIOP) was calculated as the product peak area of the variant compared with the product peak area observed by the reaction with SEQ ID NO: 5296 (where the peak area may be set as the average of replicates or else the highest single sample as appropriate). The results are shown in Table 96.2.

TABLE 96.2

| SEQ ID NO: (nt/aa) | Amino Acid Differences (Relative to SEQ ID NO: 5296) | FIOP Product Peak Area Relative to SEQ ID NO: 5296 |
|---|---|---|
| 5297/5298 | R154L/E350I | +++ |
| 5299/5300 | R154L/E187D/M220Q/E350I/Y386F | +++ |
| 5301/5302 | E187D/M220Q/E350R | +++ |
| 5303/5304 | L65R/S184T/E187D | +++ |
| 5305/5306 | E350R | ++ |
| 5307/5308 | L65R | ++ |
| 5309/5310 | R154L/S184T | ++ |
| 5311/5312 | R154L | ++ |
| 5313/5314 | V293T/E350R/Y386F | ++ |
| 5315/5316 | R154L/V293T | ++ |
| 5317/5318 | P82S/S184T/M220Q/Y386F | + |
| 5319/5320 | M220Q/V293T | + |
| 5321/5322 | S184T/E187D | + |
| 5323/5324 | V293T | + |
| 5325/5326 | M220Q | + |
| 5327/5328 | E187D/V293T | + |

TABLE 96.2-continued

| SEQ ID NO: (nt/aa) | Amino Acid Differences (Relative to SEQ ID NO: 5296) | FIOP Product Peak Area Relative to SEQ ID NO: 5296 |
|---|---|---|
| 5329/5330 | V293T/E350R | + |
| 5331/5332 | S184T/V293T | + |
| 5333/5334 | Y386F | + |
| 5335/5336 | R154L/Y386F | + |

Levels of increased activity were determined relative to the reference polypeptide of SEQ ID NO: 5296 and defined as follows: "+" 1.02 to 1.15, "++" > 1.15, "+++" > 1.25

Example 97

Improvements Over SEQ ID NO: 5296 in the Extension of Oligonucleotide Acceptor Molecules with Nucleotide Triphosphate Donors HTP Screening for Improved TdT Variants SEQ ID NO: 5296 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 97.1.

Reactions were performed in 96-well format 200 µL BioRad PCR plates. Reactions included 1-4 µM oligonucleotide, 5-50 µM nucleotide triphosphate, 0.002 Unit/µL yeast pyrophosphatase (Thermo Scientific), 20 mM buffer, 50 mM potassium acetate, and 250 µM cobalt (II) chloride. The reactions were set up as follows: (i) all reaction components, except for TdT, were pre-mixed in a single solution, and 15 µL of this solution was aliquoted into each well of the 96-well plates (ii) 5 µL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 97.1. The quenched reactions were centrifuged at 4,000 rpm for 10 min at 4° C. to pellet any precipitate. Supernatant was then transferred into new HTP plates for analytical analysis as described in Table 97.1.

TABLE 97.1

| All lysis, purification, reaction, quench, and analytical properties |
|---|
| Lysis and purification conditions : Lysis buffer - 20mM Tris-acetate, pH 8, 0.2 g/L lysozyme from chicken egg white; Lysis buffer volume - 400 μL; Lysate pre-treatment - Lysates were preincubated at 60° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide - 1 μM TTTTTTTGTA; Nucleotide triphosphate - 5 μM 3'P04-dGTP; Reaction buffer - 20 mM MOPS, pH 7.2, 0.002 Unit/pL yeast pyrophosphatase (Thermo Scientific), 50 mM potassium acetate, 250 μM cobalt (II) chloride; Reaction volume - 20 μL ; Lysate dilution - 8× dilution prior to adding to the reaction; Reaction temperature - 60° C.; Reaction time - 2 minutes |
| Quench conditions: Quench solution and volume - Reactions were quenched by the addition of 24 μL acetonitrile. The solutions were mixed well and then further diluted by the addition of 16 μL of 20 mM aqueous EDTA. ; Plate type and seal - 96-well BioRad PCR plate with a plastic seal |
| Analytical conditions: Instrument - Agilent UHPLC 1260 prime series, Agilent Ultivo - see Example 4; Reaction product detected - TTTTTTTGTAG-3'PO4 |

Activity relative to SEQ ID NO: 5296 (Activity FIOP) was calculated as the product peak area of the variant compared with the product peak area observed by the reaction with SEQ ID NO: 5296 (where the peak area may be set as the average of replicates or else the highest single sample as appropriate). The results are shown in Table 97.2.

TABLE 97.2

| SEQ ID NO: (nt/aa) | Amino Acid Differences (Relative to SEQ ID NO: 5296) | FIOP Product Peak Area Relative to SEQ ID NO: 5296 |
|---|---|---|
| 5337/5338 | L331K | +++ |
| 5339/5340 | H241S | +++ |
| 5341/5342 | H241R | +++ |
| 5343/5344 | SI 60 V | +++ |
| 5345/5346 | I368Q | +++ |
| 5347/5348 | L253V | +++ |
| 5349/5350 | 1210C | +++ |
| 5351/5352 | R200T | +++ |
| 5353/5354 | E186V | +++ |
| 5355/5356 | R200W | +++ |
| 5357/5358 | G299S | +++ |
| 5359/5360 | A188K | +++ |
| 5361/5362 | A297V | +++ |
| 5363/5364 | I194F | +++ |
| 5365/5366 | F327H | +++ |
| 5367/5368 | G299Y | +++ |
| 5369/5370 | V191M | +++ |
| 5371/5372 | G299R | +++ |
| 5373/5374 | V298T | +++ |
| 5375/5376 | E186A | +++ |
| 5377/5378 | I210T | +++ |
| 5379/5380 | H241L | +++ |
| 5381/5382 | 1368V | +++ |
| 5383/5384 | S160Y | +++ |
| 5385/5386 | E260A | +++ |
| 5387/5388 | R233L | ++ |
| 5389/5390 | D373Q | +++ |
| 5391/5392 | R200L | ++ |
| 5393/5394 | A211V | ++ |
| 5395/5396 | V191L | ++ |
| 5397/5398 | V199W | ++ |
| 5399/5400 | A206H | ++ |
| 5401/5402 | D193G | ++ |
| 5403/5404 | A188V | ++ |
| 5405/5406 | Li 92 V | ++ |
| 5407/5408 | G299V | ++ |
| 5409/5410 | P234Q | ++ |
| 5411/5412 | T209R | ++ |
| 5413/5414 | V195I | ++ |
| 5415/5416 | A297G | ++ |
| 5417/5418 | L286C | ++ |
| 5419/5420 | S160M | ++ |
| 5421/5422 | E186L | ++ |
| 5423/5424 | K196T | ++ |
| 5425/5426 | A297P | ++ |

TABLE 97.2-continued

| SEQ ID NO: (nt/aa) | Amino Acid Differences (Relative to SEQ ID NO: 5296) | FIOP Product Peak Area Relative to SEQ ID NO: 5296 |
|---|---|---|
| 5427/5428 | R290P | ++ |
| 5429/5430 | V202W | ++ |
| 5431/5432 | P234V | ++ |
| 5433/5434 | G299M | ++ |
| 5435/5436 | K272S | ++ |
| 5437/5438 | V199M | ++ |
| 5439/5440 | H241E | ++ |
| 5441/5442 | V243M | ++ |
| 5443/5444 | A190M | ++ |
| 5445/5446 | E238L | ++ |
| 5447/5448 | K292R | ++ |
| 5449/5450 | T229R | ++ |
| 5451/5452 | L192Y | ++ |
| 5453/5454 | T229G | ++ |
| 5455/5456 | D237G/H381W | ++ |
| 5457/5458 | N278S | ++ |
| 5459/5460 | T201S | ++ |
| 5461/5462 | C282T | ++ |
| 5463/5464 | K196G | ++ |
| 5465/5466 | A297F | + |
| 5467/5468 | P234R | + |
| 5469/5470 | L192T | + |
| 5471/5472 | D193R | + |
| 5473/5474 | 1258V | + |
| 5475/5476 | S203D | + |
| 5477/5478 | S203L | + |
| 5479/5480 | R233W | + |
| 5481/5482 | E238R | + |
| 5483/5484 | E260G | + |
| 5485/5486 | D189R | + |
| 5487/5488 | L288K | + |
| 5489/5490 | G299N | + |
| 5491/5492 | I258L | + |
| 5493/5494 | L227V | + |
| 5495/5496 | K272R | + |
| 5497/5498 | D193Q | + |
| 5499/5500 | H241A | + |
| 5501/5502 | I210A | + |
| 5503/5504 | D189L | + |
| 5505/5506 | H381L | + |
| 5507/5508 | I194W | + |
| 5509/5510 | D189 A | + |
| 5511/5512 | A190S | + |
| 5513/5514 | I194R | + |
| 5515/5516 | T235H | + |
| 5517/5518 | D193E | + |
| 5519/5520 | H241W | + |
| 5521/5522 | Q267T | + |
| 5523/5524 | E260M | + |
| 5525/5526 | R200M | + |
| 5527/5528 | A1901 | + |
| 5529/5530 | L247V | + |
| 5531/5532 | A188M | + |

TABLE 97.2-continued

| SEQ ID NO: (nt/aa) | Amino Acid Differences (Relative to SEQ ID NO: 5296) | FIOP Product Peak Area Relative to SEQ ID NO: 5296 |
|---|---|---|
| 5533/5534 | I258C | + |
| 5535/5536 | S160F | + |
| 5537/5538 | V298R | + |
| 5539/5540 | T198V | + |
| 5541/5542 | T201Y | + |
| 5543/5544 | I368G | + |
| 5545/5546 | P234G | + |
| 5547/5548 | V298F | + |
| 5549/5550 | D236P | + |
| 5551/5552 | E238W | + |
| 5553/5554 | H381V | + |
| 5555/5556 | L286V | + |
| 5557/5558 | S203R | + |
| 5559/5560 | I194T | + |
| 5561/5562 | K242V | + |
| 5563/5564 | V243S | + |
| 5565/5566 | R233S | + |
| 5567/5568 | P204G | + |
| 5569/5570 | V195L | + |
| 5571/5572 | E238G | + |
| 5573/5574 | A157V | + |
| 5575/5576 | L288Y | + |
| 5577/5578 | L286A | + |
| 5579/5580 | I230N | + |
| 5581/5582 | T235L | + |
| 5583/5584 | I368S | + |
| 5585/5586 | L288A | + |
| 5587/5588 | E197Q | + |
| 5589/5590 | I368T | + |
| 5591/5592 | S203I | + |

TABLE 97.2-continued

| SEQ ID NO: (nt/aa) | Amino Acid Differences (Relative to SEQ ID NO: 5296) | FIOP Product Peak Area Relative to SEQ ID NO: 5296 |
|---|---|---|

Levels of increased activity were determined relative to the reference polypeptide of SEQ ID NO: 5296 and defined as follows: "+" 1.00 to 1.04, "++" > 1.04, "+++" > 1.09

Example 98

Improvements Over SEQ ID NO: 5296 in the Extension of Oligonucleotide Acceptor Molecules with Nucleotide Triphosphate Donors HTP Screening for Improved TdT Variants SEQ ID NO: 5296 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 98.1.

Reactions were performed in 96-well format 200 µL BioRad PCR plates. Reactions included 1-4 µM oligonucleotide, 5-50 µM nucleotide triphosphate, 0.002 Unit/µL yeast pyrophosphatase (Thermo Scientific), 20 mM buffer, 50 mM potassium acetate, and 250 µM cobalt (11) chloride. The reactions were set up as follows: (i) all reaction components, except for TdT, were pre-mixed in a single solution, and 15 µL of this solution was aliquoted into each well of the 96-well plates (ii) 5 µL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 98.1. The quenched reactions were centrifuged at 4,000 rpm for 10 min at 4° C. to pellet any precipitate. Supernatant was then transferred into new HTP plates for analytical analysis as described in Table 98.1.

TABLE 98.1

| All lysis, purification, reaction, quench, and analytical properties |
|---|
| Lysis and purification conditions : Lysis buffer - 20 mM Tris-acetate, pH 8, 0.2 g/L lysozyme from chicken egg white; Lysis buffer volume - 400 µL; Lysate pre-treatment - Lysates were preincubated at 60° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide - 1 pM TTTTTTTCGT; Nucleotide triphosphate - 5 pM 3'PO4-dCTP; Reaction buffer - 20 mM MOPS, pH 7.2, 0.002 Unit/pL yeast pyrophosphatase (Thermo Scientific), 50 mM potassium acetate, 250 µM cobalt (II) chloride; Reaction volume - 20 µL ; Lysate dilution - 8× dilution prior to adding to the reaction; Reaction temperature - 60° C.; Reaction time - 5 minutes |
| Quench conditions: Quench solution and volume - Reactions were quenched by the addition of 24 µL acetonitrile. The solutions were mixed well and then further diluted by the addition of 16 µL of 20 mM aqueous EDTA. ; Plate type and seal-96-well BioRad PCR plate with a plastic seal |
| Analytical conditions: Instrument - Agilent UHPLC 1260 prime series, Agilent Ultivo - see Example 4; Reaction product detected - TTTTTTTCGTC-3'PO4 |

Activity relative to SEQ ID NO: 5296 (Activity FIOP) was calculated as the product peak area of the variant compared with the product peak area observed by the reaction with SEQ ID NO: 5296 (where the peak area may be set as the average of replicates or else the highest single sample as appropriate). The results are shown in Table 98.2.

TABLE 98.2

| SEQ ID NO: (nt/aa) | Amino Acid Differences (Relative to SEQ ID NO: 5296) | FIOP Product Peak Area Relative to SEQ ID NO: 5296 |
|---|---|---|
| 5359/5360 | A188K | +++ |
| 5393/5394 | A211V | +++ |
| 5357/5358 | G299S | +++ |
| 5401/5402 | D193G | +++ |
| 5377/5378 | I210T | +++ |

TABLE 98.2-continued

| SEQ ID NO: (nt/aa) | Amino Acid Differences (Relative to SEQ ID NO: 5296) | FIOP Product Peak Area Relative to SEQ ID NO: 5296 |
|---|---|---|
| 5369/5370 | V191M | +++ |
| 5579/5580 | I230N | +++ |
| 5353/5354 | E186V | +++ |
| 5351/5352 | R200T | +++ |
| 5355/5356 | R200W | +++ |
| 5347/5348 | L253V | +++ |
| 5505/5506 | H381L | +++ |
| 5421/5422 | E186L | +++ |
| 5341/5342 | H241R | +++ |
| 5409/5410 | P234Q | +++ |
| 5509/5510 | D189 A | +++ |
| 5405/5406 | L192V | ++ |
| 5397/5398 | V199W | ++ |
| 5361/5362 | A297V | ++ |
| 5349/5350 | 1210C | ++ |
| 5417/5418 | L286C | ++ |
| 5437/5438 | V199M | ++ |
| 5501/5502 | I210A | ++ |
| 5451/5452 | L192Y | ++ |
| 5365/5366 | F327H | ++ |
| 5387/5388 | R233L | ++ |
| 5375/5376 | E186A | ++ |
| 5457/5458 | N278S | ++ |
| 5511/5512 | Al 90S | ++ |
| 5531/5532 | A188M | ++ |
| 5527/5528 | A1901 | ++ |
| 5445/5446 | E238L | ++ |
| 5447/5448 | K292R | ++ |
| 5593/5594 | V202L | ++ |
| 5595/5596 | K196E | ++ |
| 5337/5338 | L331K | ++ |
| 5489/5490 | G299N | ++ |
| 5455/5456 | D237G/H381W | ++ |
| 5385/5386 | E260A | ++ |
| 5449/5450 | T229R | + |
| 5515/5516 | T235H | ++ |
| 5555/5556 | L286V | + |
| 5597/5598 | D373R | + |
| 5583/5584 | I368S | + |
| 5563/5564 | V243S | + |
| 5373/5374 | V298T | + |
| 5423/5424 | K196T | + |
| 5599/5600 | T201M | + |
| 5547/5548 | V298F | + |
| 5391/5392 | R200L | + |
| 5443/5444 | A190M | + |
| 5383/5384 | S160Y | + |
| 5601/5602 | I368E | + |
| 5343/5344 | S160 V | + |
| 5603/5604 | P204C | + |
| 5411/5412 | T209R | + |
| 5605/5606 | T209S | + |
| 5497/5498 | D193Q | + |
| 5517/5518 | D193E | + |
| 5589/5590 | I368T | + |
| 5607/5608 | L247F | + |
| 5485/5486 | D189R | + |
| 5609/5610 | V244S | + |
| 5389/5390 | D373Q | + |
| 5413/5414 | V195I | + |
| 5483/5484 | E260G | + |
| 5441/5442 | V243M | + |
| 5363/5364 | I194F | + |
| 5611/5612 | A190Q | + |
| 5613/5614 | T229V | + |
| 5535/5536 | S160F | + |
| 5615/5616 | D236R | + |
| 5481/5482 | E238R | + |
| 5431/5432 | P234V | + |
| 5339/5340 | H241S | + |
| 5617/5618 | E197S | + |
| 5551/5552 | E238W | + |
| 5395/5396 | V191L | + |
| 5619/5620 | P204L | + |
| 5585/5586 | L288A | + |
| 5621/5622 | S203G | + |

Levels of increased activity were determined relative to the reference polypeptide of SEQ ID NO: 5296 and defined as follows: "+" 1.00 to 1.04, "++" > 1.04, "+++" > 1.08

Example 99

Improvements Over SEQ ID NO: 5628 in the Extension of Oligonucleotide Acceptor Molecules with Nucleotide Triphosphate Donors HTP Screening for Improved TdT Variants SEQ ID NO: 5628 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 99.1.

Reactions were performed in 96-well format 200 µL BioRad PCR plates. Reactions included 1-4 µM oligonucleotide, 5-50 µM nucleotide triphosphate, 0.002 Unit/µL yeast pyrophosphatase (Thermo Scientific), 20 mM buffer, 50 mM potassium acetate, and 250 µM cobalt (11) chloride. The reactions were set up as follows: (i) all reaction components, except for TdT, were pre-mixed in a single solution, and 15 µL of this solution was aliquoted into each well of the 96-well plates (ii) 5 µL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 99.1. The quenched reactions were centrifuged at 4,000 rpm for 10 min at 4° C. to pellet any precipitate. Supernatant was then transferred into new HTP plates for analytical analysis as described in Table 99.1.

TABLE 99.1

| All lysis, purification, reaction, quench, and analytical properties |
|---|
| Lysis and purification conditions: Lysis buffer—20 mM Tris-acetate, pH 8, 0.2 g/L lysozyme from chicken egg white; Lysis buffer volume—400 µL; Lysate pre-treatment—Lysates were preincubated at 72° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide—1 µM TTTTTTTATC; Nucleotide triphosphate—5 µM 3'PO4-dCTP; Reaction buffer—20 mM MOPS, pH 7.2, 0.002 Unit/µL yeast pyrophosphatase (Thermo Scientific), 50 mM potassium acetate, 250 µM cobalt (II) chloride; Reaction volume—36 µL; Lysate dilution—8x dilution prior to adding to the reaction; Reaction temperature—72° C.; Reaction time—1 minutes |
| Quench conditions: Quench solution and volume—Reactions were quenched by adding two volumes of 90% acetonitrile and 10% methanol mixture and clarifying by centrifugation; Plate type and seal—384-well microtiter plate with seal |
| Analytical conditions: Instrument—Agilent RapidFire SPE-MS/MS—see Example 6; Reaction product detected—TTTTTTTATCC-3'PO4 |

Activity relative to SEQ ID NO: 5628 (Activity FIOP) was calculated as the product peak area of the variant compared with the product peak area observed by the reaction with SEQ ID NO: 5628 (where the peak area may be set as the average of replicates or else the highest single sample as appropriate). The results are shown in Table 99.2.

TABLE 99.2

| SEQ ID NO: (nt/aa) | Amino Acid Differences (Relative to SEQ ID NO: 5628) | FIOP Product Peak Area Relative to SEQ ID NO: 5628 |
|---|---|---|
| 5639/5640 | R200W | +++ |
| 5641/5642 | K60R/R200W/S203D/R290N | +++ |
| 5643/5644 | R200W/A206P | +++ |
| 5645/5646 | R200W/S203D/T229R/P234G | +++ |
| 5647/5648 | R200W/R290N/K292R/G360S | +++ |
| 5649/5650 | K60R | ++ |
| 5651/5652 | R200W/P234G/R290N | ++ |
| 5653/5654 | R200W/S203D/R290N | ++ |
| 5655/5656 | G360S | ++ |
| 5657/5658 | S203D | ++ |
| 5659/5660 | T229R/G360S | ++ |
| 5661/5662 | I26T/R200W/S203D | ++ |
| 5663/5664 | K60R/S203D | + |
| 5665/5666 | I26T/K60R/R200W/S203D/K292R | + |
| 5667/5668 | S203D/T229R | + |
| 5669/5670 | I26T/K60R/S203D/T229R/P234G/R290N | + |
| 5671/5672 | I26T | + |
| 5673/5674 | A157V/S162F | + |
| 5675/5676 | I26T/S203D/P234G/R290N/K292R | + |
| 5677/5678 | I26T/R200W/R290N | + |
| 5679/5680 | I26T/R200W/S203D/T229R | + |
| 5681/5682 | A157V/I368Q | + |
| 5683/5684 | I26T/K60R/R200W | + |
| 5685/5686 | S162F/K242N/I368T | + |

Levels of increased activity were determined relative to the reference polypeptide of SEQ ID NO: 5628 and defined as follows:
"+" 1.14 to 1.72,
"++" >1.72,
"+++" >2.51

Example 100

Improvements Over SEQ ID NO: 5628 in the Extension of Oligonucleotide Acceptor Molecules with Nucleotide Triphosphate Donors HTP Screening for Improved TdT Variants SEQ ID NO: 5628 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 100.1.

Reactions were performed in 96-well format 200 μL BioRad PCR plates. Reactions included 1-4 μM oligonucleotide, 5-50 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 100.1. The quenched reactions were centrifuged at 4,000 rpm for 10 min at 4° C. to pellet any precipitate. Supernatant was then transferred into new HTP plates for analytical analysis as described in Table 100.1.

TABLE 100.1

| All lysis, purification, reaction, quench, and analytical properties |
|---|
| Lysis and purification conditions: Lysis buffer—20 mM Tris-acetate, pH 8, 0.2 g/L lysozyme from chicken egg white; Lysis buffer volume—400 μL; Lysate pre-treatment—Lysates were preincubated at 60° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide—1 μM TTTTTTTGGA; Nucleotide triphosphate—5 μM 3'PO4-dTTP; Reaction buffer—20 mM MOPS, pH 7.2, 0.002 Unit/μL yeast pyrophosphatase (Thermo Scientific), 50 mM potassium acetate, 250 μM cobalt (II) chloride; Reaction volume—36 μL; Lysate dilution—8x dilution prior to adding to the reaction; Reaction temperature—60° C.; Reaction time—1 minutes |
| Quench conditions: Quench solution and volume—Reactions were quenched by adding two volumes of 90% acetonitrile and 10% methanol mixture and clarifying by centrifugation; Plate type and seal—384-well microtiter plate with seal |
| Analytical conditions: Instrument—Agilent RapidFire SPE-MS/MS—see Example 6; Reaction product detected—TTTTTTTGGAT-3'PO4 |

Activity relative to SEQ ID NO: 5628 (Activity FIOP) was calculated as the product peak area of the variant compared with the product peak area observed by the reaction with SEQ ID NO: 5628 (where the peak area may be set as the average of replicates or else the highest single sample as appropriate). The results are shown in Table 100.2.

TABLE 100.2

| SEQ ID NO: (nt/aa) | Amino Acid Differences (Relative to SEQ ID NO: 5628) | FIOP Product Peak Area Relative to SEQ ID NO: 5628 |
|---|---|---|
| 5687/5688 | K242N/L331K | +++ |
| 5689/5690 | I26T/K60R/R200W/P234G/R290N | +++ |
| 5629/5630 | A157V/S162F/L331K | +++ |
| 5643/5644 | R200W/A206P | +++ |
| 5683/5684 | I26T/K60R/R200W | +++ |
| 5669/5670 | I26T/K60R/S203D/T229R/P234G/R290N | +++ |
| 5691/5692 | K60R | +++ |
| 5641/5642 | K60R/R200W/S203D/R290N | +++ |
| 5693/5694 | R200W/S203D/T229R/P234G | +++ |
| 5655/5656 | G360S | +++ |
| 5695/5696 | K60R/R200W/P234G | ++ |
| 5697/5698 | I26T/K60R/R200W/S203D/T229R/Q267K/R290N | ++ |
| 5699/5700 | S162F/H241S/L331K | ++ |
| 5701/5702 | I26T/K60R/T229R/Q267K | ++ |
| 5703/5704 | L331K | ++ |
| 5705/5706 | A157V/S162F/K242N/E260A/L331K | ++ |
| 5707/5708 | K60R/R200W/T229R/P234G | ++ |
| 5685/5686 | S162F/K242N/I368T | ++ |
| 5709/5710 | A157V/S162F/H241S/N278G/L331K/I368Q | ++ |
| 5711/5712 | A157L/S162F/H241S/L331K | ++ |
| 5647/5648 | R200W/R290N/K292R/G360S | ++ |
| 5713/5714 | I368Q | ++ |
| 5715/5716 | I26T/K60R/R200W/S203D/T229R/P234G/Q267K | ++ |
| 5717/5718 | A157V/S162F/H241S/K242N/F327H/L331K | ++ |
| 5659/5660 | T229R/G360S | ++ |
| 5719/5720 | A157V/S162F/H241S/K242N/E260A | ++ |
| 5651/5652 | R200W/P234G/R290N | + |
| 5721/5722 | H241S/K242N/I368Q | + |
| 5723/5724 | I26T/R200W/S203D | + |
| 5725/5726 | R200W | + |
| 5727/5728 | I26T | + |
| 5677/5678 | I26T/R200W/R290N | + |
| 5729/5730 | E260A/F327H | + |
| 5665/5666 | I26T/K60R/R200W/S203D/K292R | + |
| 5731/5732 | I26T/R200W | + |
| 5733/5734 | E260A/L331K | + |
| 5735/5736 | E53T/A157V/N278G/F327H/L331K | + |
| 5737/5738 | I210T/A211V/K242N | + |
| 5739/5740 | I26T/K60R/R200W/S203D/T229R/Q267K | + |

TABLE 100.2-continued

| SEQ ID NO: (nt/aa) | Amino Acid Differences (Relative to SEQ ID NO: 5628) | FIOP Product Peak Area Relative to SEQ ID NO: 5628 |
|---|---|---|
| 5741/5742 | I26T/T229R/P234G/G360S | + |
| 5743/5744 | A157V/F327H/L331K | + |
| 5679/5680 | I26T/R200W/S203D/T229R | + |
| 5745/5746 | K60R/R200W/P234G/Q267K/R290N/K292R | + |
| 5747/5748 | I26T/K60R/R290N | + |
| 5653/5654 | R200W/S203D/R290N | + |
| 5749/5750 | K60R/R200W/P234G/R290N | + |
| 5673/5674 | A157V/S162F | + |
| 5751/5752 | K60R/S203D | + |
| 5753/5754 | I26T/K60R/R200W/S203D/P234G/Q267K | + |
| 5755/5756 | S162F/H241S/N278G/F327H/L331K | + |
| 5757/5758 | E53T/S162F/F327H/L331N/I368Q | + |
| 5759/5760 | E260A/I368Q | + |

Levels of increased activity were determined relative to the reference polypeptide of SEQ ID NO: 5628 and defined as follows:
"+" 1.11 to 1.56,
"++" >1.56,
"+++" >1.93

Example 101

Improvements Over SEQ ID NO: 5628 in the Extension of Oligonucleotide Acceptor Molecules with Nucleotide Triphosphate Donors HTP Screening for Improved TdT Variants SEQ ID NO: 5628 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 101.1.

Reactions were performed in 96-well format 200 μL BioRad PCR plates. Reactions included 1-4 μM oligonucleotide, 5-50 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 101.1. The quenched reactions were centrifuged at 4,000 rpm for 10 min at 4° C. to pellet any precipitate. Supernatant was then transferred into new HTP plates for analytical analysis as described in Table 101.1.

TABLE 101.1

| All lysis, purification, reaction, quench, and analytical properties |
|---|
| Lysis and purification conditions: Lysis buffer—20 mM Tris-acetate, pH 8, 0.2 g/L lysozyme from chicken egg white; Lysis buffer volume—400 μL; Lysate pre-treatment—Lysates were preincubated at 70° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide—1 μM TTTTTTTATC; Nucleotide triphosphate—5 μM 3'PO4-dATP; Reaction buffer—20 mM MOPS, pH 7.2, 0.002 Unit/μL yeast pyrophosphatase (Thermo Scientific), 50 mM potassium acetate, 250 μM cobalt (II) chloride; Reaction volume—20 μL; Lysate dilution—8x dilution prior to adding to the reaction; Reaction temperature—70° C.; Reaction time—2 minutes |
| Quench conditions: Quench solution and volume—Reactions were quenched by the addition of 24 μL acetonitrile. The solutions were mixed well and then further diluted by the addition of 16 μL of 20 mM aqueous EDTA.; Plate type and seal—96-well BioRad PCR plate with a plastic seal |
| Analytical conditions: Instrument—Agilent UHPLC 1260 prime series, Agilent Ultivo—see Example 4; Reaction product detected—TTTTTTTATCA-3'PO4 |

Activity relative to SEQ ID NO: 5628 (Activity FIOP) was calculated as the product peak area of the variant compared with the product peak area observed by the reaction with SEQ ID NO: 5628 (where the peak area may be set as the average of replicates or else the highest single sample as appropriate). The results are shown in Table 101.2.

TABLE 101.2

| SEQ ID NO: (nt/aa) | Amino Acid Differences (Relative to SEQ ID NO: 5628) | FIOP Product Peak Area Relative to SEQ ID NO: 5628 |
|---|---|---|
| 5761/5762 | R342W | +++ |
| 5763/5764 | R342L | +++ |
| 5765/5766 | G380V | +++ |
| 5767/5768 | R346T | +++ |
| 5769/5770 | R342C | +++ |
| 5771/5772 | S374R | +++ |
| 5773/5774 | R342Y | +++ |
| 5775/5776 | D383Q | +++ |
| 5777/5778 | R345W | +++ |
| 5779/5780 | E325T | +++ |
| 5781/5782 | R346W | +++ |
| 5783/5784 | E376M | ++ |
| 5785/5786 | R342T | ++ |
| 5787/5788 | R342S | ++ |
| 5789/5790 | R352K | ++ |
| 5791/5792 | V264E | ++ |
| 5793/5794 | E351M | ++ |
| 5795/5796 | R342C/D363S | ++ |
| 5797/5798 | V315A | ++ |
| 5799/5800 | D353N | ++ |
| 5801/5802 | T344I | ++ |
| 5803/5804 | K365S | ++ |
| 5805/5806 | R346V | ++ |
| 5807/5808 | Q275E | ++ |
| 5809/5810 | R342N | ++ |
| 5811/5812 | V264L | ++ |
| 5813/5814 | A328H | ++ |
| 5815/5816 | K366N | ++ |
| 5817/5818 | L361M | ++ |
| 5819/5820 | G217L | + |
| 5821/5822 | P273S | + |
| 5823/5824 | E376L | + |
| 5825/5826 | R352Q | + |
| 5827/5828 | D363H | + |
| 5829/5830 | D353C | + |
| 5831/5832 | G380R | + |
| 5833/5834 | E351I | + |
| 5835/5836 | E388Q | + |
| 5837/5838 | G367Y | + |
| 5839/5840 | S371C | + |
| 5841/5842 | S374A | + |
| 5843/5844 | R342G | + |
| 5845/5846 | V264M | + |
| 5847/5848 | Q275R | + |
| 5849/5850 | E351V | + |
| 5851/5852 | R342A | + |
| 5853/5854 | G256S | + |

TABLE 101.2-continued

| SEQ ID NO: (nt/aa) | Amino Acid Differences (Relative to SEQ ID NO: 5628) | FIOP Product Peak Area Relative to SEQ ID NO: 5628 |
|---|---|---|
| 5855/5856 | G367K | + |
| 5857/5858 | Q275V | + |
| 5859/5860 | D353M | + |
| 5861/5862 | E325N | + |
| 5863/5864 | E350Q | + |
| 5865/5866 | M339F | + |
| 5867/5868 | L226M | + |
| 5869/5870 | L239K | + |
| 5871/5872 | L226T | + |
| 5873/5874 | G380S | + |
| 5875/5876 | L364V | + |
| 5877/5878 | L226S | + |

Levels of increased activity were determined relative to the reference polypeptide of SEQ ID NO: 5628 and defined as follows:
"+" 1.01 to 1.20,
"++" >1.20,
"+++" >1.61

Example 102

Improvements Over SEQ ID NO: 5628 in the Extension of Oligonucleotide Acceptor Molecules with Nucleotide Triphosphate Donors HTP Screening for Improved TdT Variants SEQ ID NO: 5628 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 102.1.

Reactions were performed in 96-well format 200 μL BioRad PCR plates. Reactions included 1-4 μM oligonucleotide, 5-50 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 102.1. The quenched reactions were centrifuged at 4,000 rpm for 10 min at 4° C. to pellet any precipitate. Supernatant was then transferred into new HTP plates for analytical analysis as described in Table 102.1.

TABLE 102.1

| All lysis, purification, reaction, quench, and analytical properties |
|---|
| Lysis and purification conditions: Lysis buffer—20 mM Tris-acetate, pH 8, 0.2 g/L lysozyme from chicken egg white; Lysis buffer volume—400 μL; Lysate pre-treatment—Lysates were preincubated at 60° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide—1 μM TTTTTTTCGA; Nucleotide triphosphate—5 μM 3'PO4-dTTP; Reaction buffer—20 mM MOPS, pH 7.2, 0.002 Unit/μL yeast pyrophosphatase (Thermo Scientific), 50 mM potassium acetate, 250 μM cobalt (II) chloride; Reaction volume—20 μL; Lysate dilution—8x dilution prior to adding to the reaction; Reaction temperature—60° C.; Reaction time—2 minutes |
| Quench conditions: Quench solution and volume—Reactions were quenched by the addition of 24 μL acetonitrile. The solutions were mixed well and then further diluted by the addition of 16 μL of 20 mM aqueous EDTA.; Plate type and seal—96-well BioRad PCR plate with a plastic seal |
| Analytical conditions: Instrument—Agilent UHPLC 1260 prime series, Agilent Ultivo—see Example 4; Reaction product detected—TTTTTTTCGAT-3'PO4 |

Activity relative to SEQ ID NO: 5628 (Activity FIOP) was calculated as the product peak area of the variant compared with the product peak area observed by the reaction with SEQ ID NO: 5628 (where the peak area may be set as the average of replicates or else the highest single sample as appropriate). The results are shown in Table 102.2.

TABLE 102.2

| SEQ ID NO: (nt/aa) | Amino Acid Differences (Relative to SEQ ID NO: 5628) | FIOP Product Peak Area Relative to SEQ ID NO: 5628 |
|---|---|---|
| 5765/5766 | G380V | +++ |
| 5879/5880 | M339G | +++ |
| 5775/5776 | D383Q | +++ |
| 5881/5882 | L384V | +++ |
| 5883/5884 | E351T | +++ |
| 5847/5848 | Q275R | +++ |
| 5885/5886 | L384C | +++ |
| 5887/5888 | K365L | +++ |
| 5889/5890 | L364P | +++ |
| 5763/5764 | R342L | +++ |
| 5771/5772 | S374R | +++ |
| 5761/5762 | R342W | +++ |
| 5891/5892 | E391L | +++ |
| 5835/5836 | E388Q | +++ |
| 5803/5804 | K365S | +++ |
| 5813/5814 | A328H | +++ |
| 5893/5894 | D383V | +++ |
| 5895/5896 | K366S | +++ |
| 5793/5794 | E351M | +++ |
| 5897/5898 | D383Y | +++ |
| 5899/5900 | E376G | +++ |
| 5901/5902 | R352T | +++ |
| 5903/5904 | D353Y | +++ |
| 5791/5792 | V264E | +++ |
| 5779/5780 | E325T | +++ |
| 5769/5770 | R342C | +++ |
| 5811/5812 | V264L | +++ |
| 5905/5906 | K365Y | +++ |
| 5907/5908 | S374L | +++ |
| 5777/5778 | R345W | +++ |
| 5909/5910 | K365E | +++ |
| 5767/5768 | R346T | +++ |
| 5911/5912 | D385R | +++ |
| 5815/5816 | K366N | +++ |
| 5913/5914 | K366G | ++ |
| 5797/5798 | V315A | ++ |
| 5915/5916 | E388G | ++ |
| 5917/5918 | E351G | ++ |
| 5919/5920 | I378C | ++ |
| 5789/5790 | R352K | ++ |
| 5921/5922 | G217V | ++ |
| 5825/5826 | R352Q | ++ |
| 5923/5924 | M339A | ++ |
| 5783/5784 | E376M | ++ |
| 5925/5926 | E349T | ++ |
| 5927/5928 | R342K | ++ |
| 5929/5930 | D385V | ++ |
| 5807/5808 | Q275E | ++ |
| 5871/5872 | L226T | ++ |
| 5931/5932 | E265Y | ++ |

TABLE 102.2-continued

| SEQ ID NO: (nt/aa) | Amino Acid Differences (Relative to SEQ ID NO: 5628) | FIOP Product Peak Area Relative to SEQ ID NO: 5628 |
|---|---|---|
| 5933/5934 | E351R | ++ |
| 5781/5782 | R346W | ++ |
| 5829/5830 | D353C | ++ |
| 5935/5936 | G217Y | ++ |
| 5937/5938 | M354Q | ++ |
| 5939/5940 | L370C | ++ |
| 5941/5942 | L370F | ++ |
| 5943/5944 | G367D | ++ |
| 5945/5946 | K365A | ++ |
| 5947/5948 | L370Q | ++ |
| 5949/5950 | M354S | ++ |
| 5865/5866 | M339F | ++ |
| 5951/5952 | F369L | ++ |
| 5953/5954 | D383T | ++ |
| 5827/5828 | D363H | ++ |
| 5955/5956 | D383A | ++ |
| 5957/5958 | K365C | ++ |
| 5853/5854 | G256S | ++ |
| 5959/5960 | S374E | ++ |
| 5961/5962 | F369S | ++ |
| 5963/5964 | E349G | ++ |
| 5965/5966 | R352V | ++ |
| 5967/5968 | L382V | ++ |
| 5969/5970 | E350S | ++ |
| 5971/5972 | I378L | ++ |
| 5973/5974 | L361A | ++ |
| 5975/5976 | D383W | ++ |
| 5977/5978 | D363S | ++ |
| 5979/5980 | I378A | ++ |
| 5981/5982 | E388D | ++ |
| 5983/5984 | L361F | ++ |
| 5985/5986 | Y386T | ++ |
| 5877/5878 | L226S | ++ |
| 5849/5850 | E351V | ++ |
| 5833/5834 | E351I | ++ |
| 5987/5988 | E351S | ++ |
| 5989/5990 | V321Q | + |
| 5991/5992 | R352G | + |
| 5993/5994 | K365V | + |
| 5785/5786 | R342T | + |
| 5995/5996 | D383E | + |
| 5997/5998 | K365G | + |
| 5999/6000 | E391V | + |
| 5857/5858 | Q275V | + |
| 6001/6002 | A348S | + |
| 5859/5860 | D353M | + |
| 6003/6004 | E391W | + |
| 6005/6006 | P271S | + |
| 6007/6008 | D383K | + |
| 5845/5846 | V264M | + |
| 5839/5840 | S371C | + |
| 5823/5824 | E376L | + |
| 6009/6010 | A314C | + |
| 6011/6012 | V315T | + |
| 5809/5810 | R342N | + |
| 6013/6014 | Y386I | + |
| 6015/6016 | S134N | + |
| 6017/6018 | L364G | + |
| 6019/6020 | L370W | + |
| 6021/6022 | R352S | + |
| 5799/5800 | D353N | + |
| 6023/6024 | M354A | + |
| 6025/6026 | L370V | + |
| 6027/6028 | E351A | + |
| 6029/6030 | E391Y | + |
| 6031/6032 | K366E | + |
| 5817/5818 | L361M | + |
| 5773/5774 | R342Y | + |
| 6033/6034 | Y386L | + |
| 6035/6036 | L356C | + |
| 6037/6038 | E377R | + |
| 6039/6040 | E391G | + |
| 6041/6042 | L239Q | + |
| 5855/5856 | G367K | + |
| 6043/6044 | 1378V | + |
| 6045/6046 | V321E | + |
| 6047/6048 | K366T | + |
| 6049/6050 | D353I | + |
| 6051/6052 | G217F | + |
| 6053/6054 | G217S | + |
| 6055/6056 | E113G/L355S | + |
| 6057/6058 | A328V | + |
| 6059/6060 | L370M | + |
| 6061/6062 | E325P | + |
| 5841/5842 | S374A | + |
| 5837/5838 | G367Y | + |
| 6063/6064 | L332T | + |
| 6065/6066 | L356V | + |
| 6067/6068 | D383I | + |
| 6069/6070 | L239Y | + |
| 6071/6072 | Y362W | + |
| 6073/6074 | D353R | + |
| 6075/6076 | K313G | + |
| 5819/5820 | G217L | + |
| 6077/6078 | L370R | + |
| 6079/6080 | Q169R/W390P | + |
| 6081/6082 | E388Y | + |
| 6083/6084 | D385H | + |
| 6085/6086 | A328E | + |
| 5795/5796 | R342C/D363S | + |
| 6087/6088 | L384M | + |
| 6089/6090 | E377A | + |
| 5873/5874 | G380S | + |
| 5831/5832 | G380R | + |
| 6091/6092 | E377T | + |
| 6093/6094 | L332I | + |
| 6095/6096 | E265A | + |
| 6097/6098 | D383N | + |
| 6099/6100 | Y386V | + |
| 6101/6102 | E265S | + |
| 6103/6104 | L370S | + |
| 6105/6106 | D363L | + |
| 6107/6108 | G367L | + |
| 6109/6110 | S371G | + |
| 6111/6112 | E325G | + |
| 6113/6114 | G217H | + |
| 6115/6116 | G360M | + |
| 6117/6118 | T344S | + |
| 6119/6120 | S374W | + |
| 6121/6122 | F369N | + |
| 6123/6124 | D385L | + |
| 6125/6126 | M354I | + |

Levels of increased activity were determined relative to the reference polypeptide of SEQ ID NO: 5628 and defined as follows:
"+" 1.00 to 1.26,
"++" >1.26,
"+++" >1.56

Example 103

Improvements Over SEQ ID NO: 5630 in the Extension of Oligonucleotide Acceptor Molecules with Nucleotide Triphosphate Donors HTP Screening for Improved TdT Variants SEQ ID NO: 5630 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 103.1.

Reactions were performed in 96-well format 200 µL BioRad PCR plates. Reactions included 1-4 µM oligonucleotide, 5-50 µM nucleotide triphosphate, 0.002 Unit/µL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 103.1. The quenched reactions were centrifuged at 4,000 rpm for 10 min at 4° C. to pellet any precipitate. Supernatant was then transferred into new HTP plates for analytical analysis as described in Table 103.1.

TABLE 103.1

| All lysis, purification, reaction, quench, and analytical properties |
|---|
| Lysis and purification conditions: Lysis buffer—20 mM Tris-acetate, pH 8, 0.2 g/L lysozyme from chicken egg white; Lysis buffer volume—400 μL; Lysate pre-treatment—Lysates were preincubated at 68° C. for one hour, then centrifuged at 4,000 rpm for 10 min as described in Example 2 [Lysis of HTP Cell Pellets with Lysozyme]. The clarified supernatants were used in reactions. Reaction conditions: Oligonucleotide—1 μM TTTTTTTATC; Nucleotide triphosphate—5 μM 3'PO4-dCTP; Reaction buffer—20 mM MOPS, pH 7.2, 0.002 Unit/μL yeast pyrophosphatase (Thermo Scientific), 50 mM potassium acetate, 250 μM cobalt (II) chloride; Reaction volume—36 μL; Lysate dilution—8x dilution prior to adding to the reaction; Reaction temperature—68° C; Reaction time—2 minutes Quench conditions: Quench solution and volume—Reactions were quenched by adding two volumes of 90% acetonitrile and 10% methanol mixture and clarifying by centrifugation; Plate type and seal—384-well microtiter plate with seal Analytical conditions: Instrument—Agilent RapidFire SPE-MS/MS—see Example 6; Reaction product detected—TTTTTTTATCC-3'PO4 |

Activity relative to SEQ ID NO: 5630 (Activity FIOP) was calculated as the product peak area of the variant compared with the product peak area observed by the reaction with SEQ ID NO: 5630 (where the peak area may be set as the average of replicates or else the highest single sample as appropriate). The results are shown in Table 103.2.

TABLE 103.2

| SEQ ID NO: (nt/aa) | Amino Acid Differences (Relative to SEQ ID NO: 5630) | FIOP Product Peak Area Relative to SEQ ID NO: 5630 |
|---|---|---|
| 5631/5632 | S184T/A188K/R200W/S203D/A211V/K242N | +++ |
| 6127/6128 | S184T/R200W | +++ |
| 6129/6130 | A206P/R290N | +++ |
| 6131/6132 | A188K/A211V | +++ |
| 6133/6134 | S203D/K242N/R290N/A297F/I368T | +++ |
| 6135/6136 | I368T | +++ |
| 6137/6138 | R200W/S203D/R290N/I368T | +++ |
| 6139/6140 | S184T/A188K/A211V/K242N/R290N/I368T | ++ |
| 6141/6142 | S184T/A188K/S203D/R290N/A297F | ++ |
| 6143/6144 | S203D/A297F | ++ |
| 6145/6146 | S184T/K242N | ++ |
| 6147/6148 | S184T/A188K/R200W/S203D/R290N/A297F/I368T | ++ |
| 6149/6150 | I194F/K242N/R290N | ++ |
| 6151/6152 | S184T/A188K/R200W/S203D/K242N/A297F | ++ |
| 6153/6154 | A188K/A211V/K242N/R290N/A297F/I368T | ++ |
| 6155/6156 | A297F | ++ |

TABLE 103.2-continued

| SEQ ID NO: (nt/aa) | Amino Acid Differences (Relative to SEQ ID NO: 5630) | FIOP Product Peak Area Relative to SEQ ID NO: 5630 |
|---|---|---|
| 6157/6158 | L192V/D193G/R290N/A297F/I368T | ++ |
| 6159/6160 | S203D/A206P/I368T | ++ |
| 6161/6162 | S184T/D189A/A206P/A297F/I368T | + |
| 6163/6164 | S184T/A211V | + |
| 6165/6166 | K242N/R290N | + |
| 6167/6168 | A211V/I368T | + |
| 6169/6170 | K242N/R290N/A297F | + |
| 6171/6172 | L192V/D193G/A211V/K242N/A297F/I368T | + |
| 6173/6174 | I194F/K242N | + |
| 6175/6176 | S184T/R290N/I368T | + |
| 6177/6178 | S184T/K242N/A297F/I368T | + |
| 6179/6180 | I194F | + |
| 6181/6182 | R200W/S203D | + |
| 6183/6184 | S184T/A206P/K242N/R290N/A297F | + |
| 6185/6186 | A211V | + |
| 6187/6188 | S184T/D189A/A297F | + |
| 6189/6190 | S184T/D189A | + |
| 6191/6192 | S184T/R290N/A297F | + |
| 6193/6194 | D193G/I194F | + |
| 6195/6196 | R200W | + |

Levels of increased activity were determined relative to the reference polypeptide of SEQ ID NO: 5630 and defined as follows:
"+" 1.00 to 1.07,
"++" >1.07,
"+++" >1.16

Example 104

Improvements Over SEQ ID NO: 5630 in the Extension of Oligonucleotide Acceptor Molecules with Nucleotide Triphosphate Donors HTP Screening for Improved TdT Variants SEQ ID NO: 5630 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 104.1.

Reactions were performed in 96-well format 200 μL BioRad PCR plates. Reactions included 1-4 μM oligonucleotide, 5-50 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 104.1. The quenched reactions were centrifuged at 4,000 rpm for 10 min at 4° C. to pellet any precipitate. Supernatant was then transferred into new HTP plates for analytical analysis as described in Table 104.1.

TABLE 104.1

| All lysis, purification, reaction, quench, and analytical properties |
|---|
| Lysis and purification conditions: Lysis buffer—20 mM Tris-acetate, pH 8, 0.2 g/L lysozyme from chicken egg white; Lysis buffer volume—400 μL; Lysate pre-treatment—Lysates were preincubated at 60° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide—1 μM TTTTTTTGTT; Nucleotide triphosphate—5 μM 3'PO4-dTTP; Reaction buffer—20 mM MOPS, pH 7.2, 0.002 Unit/μL yeast pyrophosphatase (Thermo Scientific), 50 mM potassium acetate, 250 μM cobalt (II) chloride; Reaction volume—36 μL; Lysate dilution—8x dilution prior to adding to the reaction; Reaction temperature—60° C.; Reaction time—2 minutes |
| Quench conditions: Quench solution and volume—Reactions were quenched by adding two volumes of 90% acetonitrile and 10% methanol mixture and clarifying by centrifugation; Plate type and seal—384-well microtiter plate with seal |
| Analytical conditions: Instrument—Agilent RapidFire SPE-MS/MS—see Example 6; Reaction product detected—TTTTTTTGTTT-3'PO4 |

Activity relative to SEQ ID NO: 5630 (Activity FIOP) was calculated as the product peak area of the variant compared with the product peak area observed by the reaction with SEQ ID NO: 5630 (where the peak area may be set as the average of replicates or else the highest single sample as appropriate). The results are shown in Table 104.2.

TABLE 104.2

| SEQ ID NO: (nt/aa) | Amino Acid Differences (Relative to SEQ ID NO: 5630) | FIOP Product Peak Area Relative to SEQ ID NO: 5630 |
|---|---|---|
| 6137/6138 | R200W/S203D/R290N/I368T | +++ |
| 6177/6178 | S184T/K242N/A297F/I368T | +++ |
| 6165/6166 | K242N/R290N | +++ |
| 6143/6144 | S203D/A297F | +++ |
| 6151/6152 | S184T/A188K/R200W/S203D/K242N/A297F | +++ |
| 6171/6172 | L192V/D193G/A211V/K242N/A297F/I368T | +++ |
| 6127/6128 | S184T/R200W | ++ |
| 6197/6198 | A297F | ++ |
| 6145/6146 | S184T/K242N | ++ |
| 6157/6158 | L192V/D193G/R290N/A297F/I368T | ++ |
| 6199/6200 | A206P/A297F | ++ |
| 6129/6130 | A206P/R290N | ++ |
| 6175/6176 | S184T/R290N/I368T | ++ |
| 6181/6182 | R200W/S203D | ++ |
| 6161/6162 | S184T/D189A/A206P/A297F/I368T | ++ |
| 6135/6136 | I368T | + |
| 5631/5632 | S184T/A188K/R200W/S203D/A211V/K242N | + |
| 6201/6202 | S184T | + |
| 6203/6204 | D189A/R200W | + |
| 6167/6168 | A211V/I368T | + |
| 6139/6140 | S184T/A188K/A211V/K242N/R290N/I368T | + |
| 6173/6174 | I194F/K242N | + |
| 6141/6142 | S184T/A188K/S203D/R290N/A297F | + |
| 6191/6192 | S184T/R290N/A297F | + |
| 6159/6160 | S203D/A206P/I368T | + |
| 6147/6148 | S184T/A188K/R200W/S203D/R290N/A297F/I368T | + |
| 6169/6170 | K242N/R290N/A297F | + |
| 6205/6206 | S184T/D189A | + |
| 6153/6154 | A188K/A211V/K242N/R290N/A297F/I368T | + |
| 6195/6196 | R200W | + |

Levels of increased activity were determined relative to the reference polypeptide of SEQ ID NO: 5630 and defined as follows:
"+" 1.01 to 1.10,
"++" >1.10,
"+++" >1.18

Example 105

Improvements Over SEQ ID NO: 5632 in the Extension of Oligonucleotide Acceptor Molecules with Nucleotide Triphosphate Donors HTP Screening for Improved TdT Variants SEQ ID NO: 5632 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 105.1.

Reactions were performed in 96-well format 200 μL BioRad PCR plates. Reactions included 1-4 μM oligonucleotide, 5-50 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 105.1. The quenched reactions were centrifuged at 4,000 rpm for 10 min at 4° C. to pellet any precipitate. Supernatant was then transferred into new HTP plates for analytical analysis as described in Table 105.1.

TABLE 105.1

| All lysis, purification, reaction, quench, and analytical properties |
|---|
| Lysis and purification conditions: Lysis buffer—20 mM Tris-acetate, pH 8, 0.2 g/L lysozyme from chicken egg white; Lysis buffer volume—400 μL; Lysate pre-treatment—Lysates were preincubated at 68° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide—1 μM TTTTTTTATC; Nucleotide triphosphate—5 μM 3'PO4-dATP; Reaction buffer—20 mM MOPS, pH 7.2, 0.002 Unit/μL yeast pyrophosphatase (Thermo Scientific), 50 mM potassium acetate, 250 μM cobalt (II) chloride; Reaction volume—20 μL; Lysate dilution—8x dilution prior to adding to the reaction; Reaction temperature—68° C.; Reaction time—2 minutes |
| Quench conditions: Quench solution and volume—Reactions were quenched by the addition of 24 μL acetonitrile. The solutions were mixed well and then further diluted by the addition of 16 μL of 20 mM aqueous EDTA.; Plate type and seal—96-well BioRad PCR plate with a plastic seal |
| Analytical conditions: Instrument—Agilent UHPLC 1260 prime series, Agilent Ultivo—see Example 4; Reaction product detected—TTTTTTTATCA-3'PO4 |

Activity relative to SEQ ID NO: 5632 (Activity FIOP) was calculated as the product peak area of the variant compared with the product peak area observed by the reaction with SEQ ID NO: 5632 (where the peak area may be set as the average of replicates or else the highest single sample as appropriate). The results are shown in Table 105.2.

TABLE 105.2

| SEQ ID NO: (nt/aa) | Amino Acid Differences (Relative to SEQ ID NO: 5632) | FIOP Product Peak Area Relative to SEQ ID NO: 5632 |
|---|---|---|
| 6207/6208 | T209E/V211A | +++ |
| 6209/6210 | K272N | +++ |
| 6211/6212 | K272E | +++ |
| 6213/6214 | P273- | +++ |
| 6215/6216 | N278G | +++ |
| 6217/6218 | K331E | +++ |
| 6219/6220 | L65E | +++ |
| 6221/6222 | K331T | +++ |
| 6223/6224 | R345W | +++ |
| 6225/6226 | R73M | +++ |
| 6227/6228 | R345Q | +++ |
| 6229/6230 | P219E | +++ |
| 6231/6232 | P273E | +++ |
| 5633/5634 | K272A | +++ |
| 6233/6234 | Q66G | +++ |
| 6235/6236 | P219S/T300A | ++ |
| 6237/6238 | E144G/Q220R | ++ |
| 6239/6240 | A128V/S296G | ++ |
| 6241/6242 | L65N | ++ |
| 6243/6244 | L151W | ++ |
| 6245/6246 | L151H | ++ |
| 6247/6248 | R261S | ++ |
| 6249/6250 | I210V/V211A | ++ |
| 6251/6252 | R73G | ++ |
| 6253/6254 | Q66A | ++ |
| 6255/6256 | D324E | ++ |
| 6257/6258 | P273L | ++ |
| 6259/6260 | L65M | ++ |
| 6261/6262 | V140T | ++ |
| 6263/6264 | K292T | ++ |
| 6265/6266 | P219T | ++ |
| 6267/6268 | K292D | ++ |
| 6269/6270 | Y59H | ++ |
| 6271/6272 | Q66N | ++ |
| 6273/6274 | M149I | ++ |
| 6275/6276 | K272R | ++ |
| 6277/6278 | F327Y | ++ |
| 6279/6280 | D373Q | + |
| 6281/6282 | K292R | + |
| 6283/6284 | A56G | + |
| 6285/6286 | P219I | + |
| 6287/6288 | P219V | + |
| 6289/6290 | A159E | + |
| 6291/6292 | Q66L | + |
| 6293/6294 | K272T | + |
| 6295/6296 | L151Y | + |
| 6297/6298 | D373K | + |
| 6299/6300 | L364R | + |
| 6301/6302 | P219S | + |
| 6303/6304 | S371F | + |
| 6305/6306 | F327A | + |
| 6307/6308 | L65P | + |
| 6309/6310 | A159R | + |
| 6311/6312 | A159Q | + |
| 6313/6314 | Q275L | + |
| 6315/6316 | E57M | + |
| 6317/6318 | A159N | + |
| 6319/6320 | S371K | + |
| 6321/6322 | A159S | + |
| 6323/6324 | D373G | + |
| 6325/6326 | E63G | + |
| 6327/6328 | S371P | + |
| 6329/6330 | D373T | + |
| 6331/6332 | P219N | + |
| 6333/6334 | L151K | + |
| 6335/6336 | Q275E | + |
| 6337/6338 | M149L | + |
| 6339/6340 | I230V | + |
| 6341/6342 | K292Y | + |
| 6343/6344 | K292G | + |
| 6345/6346 | D373R | + |
| 6347/6348 | S371T | + |

TABLE 105.2-continued

| SEQ ID NO: (nt/aa) | Amino Acid Differences (Relative to SEQ ID NO: 5632) | FIOP Product Peak Area Relative to SEQ ID NO: 5632 |
|---|---|---|
| 6349/6350 | Y59W | + |
| 6351/6352 | M149E | + |

Levels of increased activity were determined relative to the reference polypeptide of SEQ ID NO: 5632 and defined as follows:
"+" 1.01 to 1.22,
"++" >1.22,
"+++" >1.70

Example 106

Improvements Over SEQ ID NO: 5632 in the Extension of Oligonucleotide Acceptor Molecules with Nucleotide Triphosphate Donors HTP Screening for Improved TdT Variants SEQ ID NO: 5632 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 106.1.

Reactions were performed in 96-well format 200 µL BioRad PCR plates. Reactions included 1-4 µM oligonucleotide, 5-50 µM nucleotide triphosphate, 0.002 Unit/µL yeast pyrophosphatase (Thermo Scientific), 20 mM buffer, 50 mM potassium acetate, and 250 µM cobalt (II) chloride. The reactions were set up as follows: (i) all reaction components, except for TdT, were pre-mixed in a single solution, and 15 µL of this solution was aliquoted into each well of the 96-well plates (ii) 5 µL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 106.1. The quenched reactions were centrifuged at 4,000 rpm for 10 min at 4° C. to pellet any precipitate. Supernatant was then transferred into new HTP plates for analytical analysis as described in Table 106.1.

TABLE 106.1

| All lysis, purification, reaction, quench, and analytical properties |
|---|
| Lysis and purification conditions: Lysis buffer—20 mM Tris-acetate, pH 8, 0.2 g/L lysozyme from chicken egg white; Lysis buffer volume—400 µL; Lysate pre-treatment—Lysates were preincubated at 60° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide—1 µM TTTTTTTGGA; Nucleotide triphosphate—5 µM 3'PO4-dTTP; Reaction buffer—20 mM MOPS, pH 7.2, 0.002 Unit/µL yeast pyrophosphatase (Thermo Scientific), 50 mM potassium acetate, 250 µM cobalt (II) chloride; Reaction volume—20 µL; Lysate dilution—8x dilution prior to adding to the reaction; Reaction temperature—60° C.; Reaction time—2 minutes |
| Quench conditions: Quench solution and volume—Reactions were quenched by the addition of 24 µL acetonitrile. The solutions were mixed well and then further diluted by the addition of 16 µL of 20 mM aqueous EDTA.; Plate type and seal—96-well BioRad PCR plate with a plastic seal |
| Analytical conditions: Instrument—Agilent UHPLC 1260 prime series, Agilent Ultivo—see Example 4; Reaction product detected—TTTTTTTGGAT-3'PO4 |

Activity relative to SEQ ID NO: 5632 (Activity FIOP) was calculated as the product peak area of the variant compared with the product peak area observed by the reaction with SEQ ID NO: 5632 (where the peak area may be set as the average of replicates or else the highest single sample as appropriate). The results are shown in Table 106.2.

TABLE 106.2

| SEQ ID NO: (nt/aa) | Amino Acid Differences (Relative to SEQ ID NO: 5632) | FIOP Product Peak Area Relative to SEQ ID NO: 5632 |
|---|---|---|
| 6353/6354 | M339E | +++ |
| 6265/6266 | P219T | +++ |
| 6355/6356 | L151M | +++ |
| 6329/6330 | D373T | +++ |
| 6357/6358 | F61M | +++ |
| 6311/6312 | A159Q | +++ |
| 6359/6360 | A159T | +++ |
| 6207/6208 | T209E/V211A | +++ |
| 6361/6362 | V140L | +++ |
| 5633/5634 | K272A | +++ |
| 6363/6364 | Y59L | +++ |
| 6249/6250 | I210V/V211A | +++ |
| 6239/6240 | A128V/S296G | +++ |
| 6365/6366 | A128S | +++ |
| 6367/6368 | K292I | +++ |
| 6347/6348 | S371T | +++ |
| 6321/6322 | A159S | +++ |
| 6323/6324 | D373G | +++ |
| 6259/6260 | L65M | +++ |
| 6369/6370 | I230C | +++ |
| 6297/6298 | D373K | +++ |
| 6229/6230 | P219E | +++ |
| 6371/6372 | K158P | +++ |
| 6227/6228 | R345Q | +++ |
| 6343/6344 | K292G | +++ |
| 6373/6374 | Q66V | +++ |
| 6287/6288 | P219V | +++ |
| 6375/6376 | M149G | +++ |
| 6377/6378 | T209A/V211A | ++ |
| 6339/6340 | I230V | ++ |
| 6379/6380 | I230A | ++ |
| 6381/6382 | K158D | ++ |
| 6383/6384 | T209H/V211A | ++ |
| 6385/6386 | R261G | ++ |
| 6387/6388 | F327A | ++ |
| 6389/6390 | Q275V | ++ |
| 6391/6392 | Y59Q | ++ |
| 6271/6272 | Q66N | ++ |
| 6393/6394 | N242G | ++ |
| 6327/6328 | S371P | ++ |
| 6345/6346 | D373R | ++ |
| 6395/6396 | K79R | ++ |
| 6251/6252 | R73G | ++ |
| 6263/6264 | K292T | ++ |
| 6397/6398 | K158G | ++ |
| 6399/6400 | E156H | ++ |
| 6301/6302 | P219S | ++ |
| 6401/6402 | E155N | ++ |
| 6403/6404 | D324K | ++ |
| 6335/6336 | Q275E | ++ |
| 6405/6406 | L65T | ++ |
| 6279/6280 | D373Q | ++ |
| 6407/6408 | A75S | ++ |
| 6409/6410 | A128T | ++ |
| 6411/6412 | L151I | ++ |
| 6413/6414 | T209S/V211A | ++ |
| 6415/6416 | L151P | ++ |
| 6417/6418 | A159H | ++ |
| 6419/6420 | F61Y | ++ |
| 6255/6256 | D324E | ++ |
| 6421/6422 | N278S | ++ |
| 6209/6210 | K272N | ++ |
| 6423/6424 | E57A | ++ |
| 6299/6300 | L364R | ++ |
| 6257/6258 | P273L | ++ |
| 6425/6426 | H381L | ++ |
| 6427/6428 | E155S | ++ |
| 6429/6430 | V140M | ++ |

TABLE 106.2-continued

| SEQ ID NO: (nt/aa) | Amino Acid Differences (Relative to SEQ ID NO: 5632) | FIOP Product Peak Area Relative to SEQ ID NO: 5632 |
|---|---|---|
| 6431/6432 | V140S | ++ |
| 6433/6434 | I230S | ++ |
| 6435/6436 | D324R | + |
| 6437/6438 | I230M | + |
| 6439/6440 | V211A | + |
| 6441/6442 | V140G | + |
| 6443/6444 | W200R/V202T/D203S | + |
| 6445/6446 | E57C | + |
| 6289/6290 | A159E | + |
| 6447/6448 | A128G | + |
| 6449/6450 | P219H | + |
| 6215/6216 | N278G | + |
| 6317/6318 | A159N | + |
| 6451/6452 | L151V | + |
| 6453/6454 | S134C | + |
| 6319/6320 | S371K | + |
| 6455/6456 | R345K | + |
| 6457/6458 | V157T | + |
| 6459/6460 | F61S | + |
| 6461/6462 | E155P | + |
| 6235/6236 | P219S/T300A | + |
| 6463/6464 | R261A | + |
| 6267/6268 | K292D | + |
| 6465/6466 | T262S | + |
| 6219/6220 | L65E | + |
| 6293/6294 | K272T | + |
| 6467/6468 | P219G | + |
| 6313/6314 | Q275L | + |
| 6469/6470 | E155A | + |
| 6471/6472 | A322C | + |
| 6473/6474 | D373V | + |
| 6475/6476 | E144A | + |
| 6477/6478 | L319F | + |
| 6479/6480 | A159G | + |
| 6481/6482 | K158M | + |
| 6483/6484 | D324G | + |
| 6283/6284 | A56G | + |
| 6277/6278 | F327Y | + |
| 6337/6338 | M149L | + |
| 6269/6270 | Y59H | + |
| 6485/6486 | K158A | + |
| 6487/6488 | I228L | + |
| 6315/6316 | E57M | + |
| 6489/6490 | R261N | + |
| 6491/6492 | F327S | + |
| 6281/6282 | K292R | + |
| 6241/6242 | L65N | + |
| 6493/6494 | A128K | + |
| 6495/6496 | E155L | + |
| 6497/6498 | S371R | + |
| 6499/6500 | N270C | + |
| 6501/6502 | M149T | + |
| 6503/6504 | N242S | + |
| 6341/6342 | K292Y | + |
| 6505/6506 | D324S | + |
| 6507/6508 | S134Q | + |
| 6509/6510 | K158S | + |
| 6511/6512 | K145L | + |
| 6307/6308 | L65P | + |
| 6331/6332 | P219N | + |
| 6513/6514 | E155K | + |
| 6515/6516 | N270Q | + |
| 6517/6518 | A74T/K272G | + |
| 6519/6520 | T262E | + |
| 6521/6522 | T344L | + |
| 6523/6524 | F61W | + |
| 6525/6526 | S134L | + |
| 6309/6310 | A159R | + |
| 6527/6528 | N242K/V244T | + |
| 6529/6530 | Y59F | + |
| 6531/6532 | P219R | + |
| 6247/6248 | R261S | + |

Levels of increased activity were determined relative to the reference polypeptide of SEQ ID NO: 5632 and defined as follows: "+" 1.00 to 1.16, "++" > 1.16, "+++" > 1.26

Example 107

Improvements Over SEQ ID NO: 5636 in the Extension of Oligonucleotide Acceptor Molecules with Nucleotide Triphosphate Donors HTP Screening for Improved TdT Variants SEQ ID NO: 5636 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 107.1.

Reactions were performed in 96-well format 200 μL BioRad PCR plates. Reactions included 1-4 μM oligonucleotide, 5-50 μM nucleotide triphosphate, 0.002 Unit/μL yeast pyrophosphatase (Thermo Scientific), 20 mM buffer, 50 mM potassium acetate, and 250 μM cobalt (II) chloride. The reactions were set up as follows: (i) all reaction components, except for TdT, were pre-mixed in a single solution, and 15 μL of this solution was aliquoted into each well of the 96-well plates (ii) 5 μL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 107.1. The quenched reactions were centrifuged at 4,000 rpm for 10 min at 4° C. to pellet any precipitate. Supernatant was then transferred into new HTP plates for analytical analysis as described in Table 107.1.

TABLE 107.1

| All lysis, purification, reaction, quench, and analytical properties |
|---|
| Lysis and purification conditions: Lysis buffer—20 mM Tris-acetate, pH 8, 0.2 g/L lysozyme from chicken egg white; Lysis buffer volume—400 μL; Lysate pre-treatment—Lysates were preincubated at 68° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide—1 μM TTTTTTTATC; Nucleotide triphosphate—5 μM 3'PO4-dATP; Reaction buffer—20 mM MOPS, pH 7.2, 0.002 Unit/μL yeast pyrophosphatase (Thermo Scientific), 50 mM potassium acetate, 250 μM cobalt (II) chloride; Reaction volume—20 μL; Lysate dilution—8× dilution prior to adding to the reaction; Reaction temperature—68° C.; Reaction time—2 minutes |
| Quench conditions: Quench solution and volume—Reactions were quenched by adding two volumes of 90% acetonitrile and 10% methanol mixture and clarifying by centrifugation; Plate type and seal—384-well microtiter plate with seal |
| Analytical conditions: Instrument—Agilent RapidFire SPE-MS/MS—see Example 6; Reaction product detected —TTTTTTTATCA-3'PO4 |

Activity relative to SEQ ID NO: 5636 (Activity FIOP) was calculated as the product peak area of the variant compared with the product peak area observed by the reaction with SEQ ID NO: 5636 (where the peak area may be set as the average of replicates or else the highest single sample as appropriate). The results are shown in Table 107.2.

TABLE 107.2

| SEQ ID NO: (nt/aa) | Amino Acid Differences (Relative to SEQ ID NO: 5636) | FIOP Product Peak Area Relative to SEQ ID NO: 5636 |
|---|---|---|
| 6533/6534 | T209E/R352K/D353N/S371P | +++ |
| 6535/6536 | T209E | +++ |
| 6537/6538 | E155K/T209E | +++ |
| 5637/5638 | A159R/T209E/R352K/D353N | +++ |
| 6539/6540 | L65M/T209E/R352K/D353N/S371P | +++ |
| 6541/6542 | L151K/T209E | +++ |
| 6543/6544 | T209E/P219T/R352K/D353N/S371P | +++ |
| 6545/6546 | L65M/E155K/T209E/R352K/D353N | +++ |
| 6547/6548 | T209E/P219T/S371P | +++ |
| 6549/6550 | L65M/R352K/D353N/S371P | +++ |
| 6551/6552 | L65M/E155K/T209E | ++ |
| 6553/6554 | T209E/D373T | ++ |
| 6555/6556 | T209E/I228L | ++ |
| 6557/6558 | A128K/T209E/I228L/S371P | ++ |
| 6559/6560 | P219T/R352K/D353N/S371P/D373T | ++ |
| 6561/6562 | R352K/D353N | ++ |
| 6563/6564 | L151K/T209E/S371P | ++ |
| 6565/6566 | L65M/A128K/T209E/S371P/D373T | ++ |
| 6567/6568 | T209E/S371P | ++ |
| 6569/6570 | A128K/G338D/R352K/D353N/ D373T | ++ |
| 6571/6572 | L65M/I228L/R352K/D353N/D373T | ++ |
| 6573/6574 | T209E/S371P/D373T | ++ |
| 6575/6576 | I228L/S371P | ++ |
| 6577/6578 | L65M/E70Q/E155K/T209E/I228L | ++ |
| 6579/6580 | L151K/T209E/D373T | ++ |
| 6581/6582 | I228L/S371P/D373T | ++ |
| 6583/6584 | A128K/T209E/P219T/R352K/ D353N/S371P | + |
| 6585/6586 | A128K/T209E/S371P/D373T | + |
| 6587/6588 | V208M/T209E | + |
| 6589/6590 | S371P/D373T | + |
| 6591/6592 | L151K/R352K/D353N/S371P/D373T | + |
| 6593/6594 | L65M | + |
| 6595/6596 | D373T | + |
| 6597/6598 | A128K/T209E/S371P | + |
| 6599/6600 | L65M/A159R | + |
| 6601/6602 | P219T/S371P/D373T | + |
| 6603/6604 | I228L | + |
| 6605/6606 | L151K/I228L/R352K/D353N/D373T | + |
| 6607/6608 | L151K/R352K/D353N | + |
| 6609/6610 | E155K/I228L/R352K/D353N | + |
| 6611/6612 | A128K/T209E | + |
| 6613/6614 | A128K/T209E/D373T | + |
| 6615/6616 | L65M/I228L/S371P/D373T | + |
| 6617/6618 | I228L/D373T | + |
| 6619/6620 | L65M/T209E/P219T/R352K/D353N | + |

TABLE 107.2-continued

| SEQ ID NO: (nt/aa) | Amino Acid Differences (Relative to SEQ ID NO: 5636) | FIOP Product Peak Area Relative to SEQ ID NO: 5636 |
|---|---|---|
| 6621/6622 | L65M/L151K | + |
| 6623/6624 | L151K/I228L/D373T | + |
| 6625/6626 | S371P | + |
| 6627/6628 | R352K/D353N/S371P | + |
| 6629/6630 | P219T/I228L | + |
| 6631/6632 | A128K/A159R/T209E/R352K/D353N | + |
| 6633/6634 | A128K/T209E/P219T | + |
| 6635/6636 | E155K | + |

Levels of increased activity were determined relative to the reference polypeptide of SEQ ID NO: 5636 and defined as follows: "+" 1.06 to 1.64, "++" > 1.64, "+++" > 2.70

Example 108

Improvements Over SEQ ID NO: 5636 in the Extension of Oligonucleotide Acceptor Molecules with Nucleotide Triphosphate Donors HTP Screening for Improved TdT Variants SEQ ID NO: 5636 was selected as the parent TdT enzyme. Libraries of engineered genes were produced from the parent gene using well-established techniques (e.g., saturation mutagenesis and recombination of previously identified beneficial mutations). The polypeptides encoded by each gene were produced in HTP and prepared as described in Table 108.1.

Reactions were performed in 96-well format 200 µL BioRad PCR plates. Reactions included 1-4 µM oligonucleotide, 5-50 µM nucleotide triphosphate, 0.002 Unit/µL yeast pyrophosphatase (Thermo Scientific), 20 mM buffer, 50 mM potassium acetate, and 250 µM cobalt (II) chloride. The reactions were set up as follows: (i) all reaction components, except for TdT, were pre-mixed in a single solution, and 15 µL of this solution was aliquoted into each well of the 96-well plates (ii) 5 µL of TdT solution was then added into the wells to initiate the reaction. The reaction plate was heat-sealed with a peelable aluminum seal and incubated in a thermocycler at the indicated temperature and reaction time, then held at 4° C. until the reaction was quenched. Reaction and quench details are specified in Table 108.1. The quenched reactions were centrifuged at 4,000 rpm for 10 min at 4° C. to pellet any precipitate. Supernatant was then transferred into new HTP plates for analytical analysis as described in Table 108.1.

TABLE 108.1

| All lysis, purification, reaction, quench, and analytical properties |
|---|
| Lysis and purification conditions: Lysis buffer—20 mM Tris-acetate, pH 8, 0.2 g/L lysozyme from chicken egg white; Lysis buffer volume—400 µL; Lysate pre-treatment—Lysates were preincubated at 60° C. for one hour, then centrifuged at 4,000 rpm for 10 min as described in Example 2 [Lysis of HTP Cell Pellets with Lysozyme]. The clarified supernatants were used in reactions. |
| Reaction conditions: Oligonucleotide—1 µM TTTTTTTGGA; Nucleotide triphosphate—5 µM 3'PO4-dTTP; Reaction buffer—20 mM MOPS, pH 7.2, 0.002 Unit/µL yeast pyrophosphatase (Thermo Scientific), 50 mM potassium acetate, 250 µM cobalt (II) chloride; Reaction volume—20 µL; Lysate dilution—8× dilution prior to adding to the reaction; Reaction temperature—60° C.; Reaction time—2 minutes |
| Quench conditions: Quench solution and volume—Reactions were quenched by adding two volumes of 90% acetonitrile and 10% methanol mixture and clarifying by centrifugation; Plate type and seal—384-well microtiter plate with seal |
| Analytical conditions: Instrument—Agilent RapidFire SPE-MS/MS—see Example 6; Reaction product detected—TTTTTTTGGAT-3'PO4 |

Activity relative to SEQ ID NO: 5636 (Activity FIOP) was calculated as the product peak area of the variant compared with the product peak area observed by the reaction with SEQ ID NO: 5636 (where the peak area may be set as the average of replicates or else the highest single sample as appropriate). The results are shown in Table 108.2.

TABLE 108.2

| SEQ ID NO: (nt/aa) | Amino Acid Differences (Relative to SEQ ID NO: 5636) | FIOP Product Peak Area Relative to SEQ ID NO: 5636 |
|---|---|---|
| 6637/6638 | A128K/R352K/D353N | +++ |
| 6563/6564 | L151K/T209E/S371P | +++ |
| 6559/6560 | P219T/R352K/D353N/S371P/D373T | +++ |
| 6639/6640 | A128K/T209E/D373T | +++ |
| 6549/6550 | L65M/R352K/D353N/S371P | +++ |
| 6585/6586 | A128K/T209E/S371P/D373T | +++ |
| 6641/6642 | P219T/R352K/D353N/D373T | +++ |
| 6643/6644 | S371P/D373T | +++ |
| 6645/6646 | T209E/S371P/D373T | +++ |
| 6627/6628 | R352K/D353N/S371P | +++ |
| 6647/6648 | R352K/D353N/D373T | +++ |
| 6557/6558 | A128K/T209E/I228L/S371P | +++ |
| 6533/6534 | T209E/R352K/D353N/S371P | +++ |
| 6583/6584 | A128K/T209E/P219T/R352K/D353N/S371P | +++ |
| 6649/6650 | L65M/D373T | +++ |
| 6571/6572 | L65M/I228L/R352K/D353N/D373T | +++ |
| 6651/6652 | A128K/R352K/D353N/D373T | +++ |
| 6653/6654 | E155K/R352K/D353N/D373T | +++ |
| 6633/6634 | A128K/T209E/P219T | +++ |
| 6619/6620 | L65M/T209E/P219T/R352K/D353N | ++ |
| 6655/6656 | L65M/A128K/A159Q/T209E/S371P/D373T | +++ |
| 6657/6658 | A128K/T209E | ++ |
| 6659/6660 | A128K/T209E/S371P | ++ |
| 6601/6602 | P219T/S371P/D373T | ++ |
| 6631/6632 | A128K/A159R/T209E/R352K/D353N | ++ |
| 6661/6662 | A128K/P219T/R352K/D353N | ++ |
| 6663/6664 | L151K/T209E | ++ |
| 6567/6568 | T209E/S371P | ++ |
| 6665/6666 | R352K/D353N | ++ |
| 6667/6668 | L65M | ++ |
| 6669/6670 | A128K/P219T/S371P/D373T | ++ |
| 6671/6672 | L151K/E155K/T209E/D373T | ++ |
| 6543/6544 | T209E/P219T/R352K/D353N/S371P | ++ |
| 6673/6674 | L65M/A128K/P219T/D373T | ++ |
| 6547/6548 | T209E/P219T/S371P | ++ |
| 6675/6676 | T209E/D373T | ++ |
| 6565/6566 | L65M/A128K/T209E/S371P/D373T | ++ |
| 6537/6538 | E155K/T209E | ++ |
| 5637/5638 | A159R/T209E/R352K/D353N | ++ |

TABLE 108.2-continued

| SEQ ID NO: (nt/aa) | Amino Acid Differences (Relative to SEQ ID NO: 5636) | FIOP Product Peak Area Relative to SEQ ID NO: 5636 |
|---|---|---|
| 6545/6546 | L65M/E155K/T209E/R352K/D353N | ++ |
| 6607/6608 | L151K/R352K/D353N | ++ |
| 6591/6592 | L151K/R352K/D353N/S371P/D373T | ++ |
| 6677/6678 | I228L/R352K/D353N | ++ |
| 6539/6540 | L65M/T209E/R352K/D353N/S371P | ++ |
| 6581/6582 | I228L/S371P/D373T | ++ |
| 6579/6580 | L151K/T209E/D373T | ++ |
| 6615/6616 | L65M/I228L/S371P/D373T | ++ |
| 6679/6680 | A128K | ++ |
| 6681/6682 | A128K/I228L/R352K/D353N | ++ |
| 6683/6684 | L151K/E155K/R352K/D353N/S371P/D373T | ++ |
| 6685/6686 | A128K/S371P | ++ |
| 6687/6688 | A128K/S371P/D373T | + |
| 6689/6690 | L151K/P219T | + |
| 6621/6622 | L65M/L151K | + |
| 6691/6692 | L151K/E155K/P219T/R352K/D353N/S371P | + |
| 6693/6694 | L151K/E155K/R352K/D353N | + |
| 6695/6696 | E155K/S371P/D373T | + |
| 6697/6698 | E155K/D373T | + |
| 6551/6552 | L65M/E155K/T209E | + |
| 6699/6700 | L151K/S371P | + |
| 6701/6702 | L65M/A128K/D373T | + |
| 6703/6704 | L65M/A128K/T209E/S371P | + |
| 6705/6706 | D373T | + |
| 6599/6600 | L65M/A159R | + |
| 6707/6708 | P219T/S371P | + |
| 6709/6710 | L65M/A128K | + |
| 6711/6712 | T209E | + |
| 6713/6714 | L65M/A128K/E155K/T209E/S371P | + |
| 6715/6716 | L151K/E155K/R352K/D353N/D373T | + |
| 6717/6718 | L65M/R352K/D353N | + |
| 6719/6720 | E155K/S371P | + |
| 6721/6722 | L65M/E70Q/I228L/D373T | + |
| 6723/6724 | L151K | + |
| 6725/6726 | A128K/A159Q | + |
| 6609/6610 | E155K/I228L/R352K/D353N | + |
| 6727/6728 | L151K/E155K/T209E/P219T/I228L/S371P/D373T | + |
| 6605/6606 | L151K/I228L/R352K/D353N/D373T | + |
| 6625/6626 | S371P | + |
| 6729/6730 | E70Q/E155K/R352K/D353N | + |
| 6617/6618 | I228L/D373T | + |
| 6555/6556 | T209E/I228L | + |
| 6623/6624 | L151K/I228L/D373T | + |
| 6731/6732 | L65M/I228L/S371P | + |
| 6629/6630 | P219T/I228L | + |
| 6733/6734 | L151K/D373T | + |
| 6735/6736 | M55T/L65M/L151K | + |
| 6737/6738 | E155K/I228L/S371P | + |
| 6739/6740 | L151K/E155K/T209E | + |
| 6741/6742 | A128K/A159R | + |
| 6743/6744 | A128K/E155K/T209E | + |
| 6575/6576 | I228L/S371P | + |
| 6745/6746 | L151K/T209E/S371P/D373T | + |
| 6747/6748 | E155K/I228L/S371P/D373T | + |
| 6749/6750 | L151K/P219T/S371P | + |
| 6751/6752 | L65M/P219T/S371P | + |
| 6577/6578 | L65M/E70Q/E155K/T209E/I228L | + |
| 6753/6754 | A128K/I228L/D373T | + |
| 6755/6756 | P219T | + |
| 6757/6758 | E155K/P219T | + |
| 6759/6760 | A128K/D373T | + |
| 6761/6762 | L151K/E155K | + |
| 6763/6764 | A128K/I228L/S371P | + |
| 6765/6766 | E155K | + |

Levels of increased activity were determined relative to the reference polypeptide of SEQ ID NO: 5636 and defined as follows: "+" 1.01 to 1.45, "++" > 1.45, "+++" > 1.68

Example 109

Screening of Shake-Flask Purified TdT for the Reduction of by-Products Generated by the TdT-Dependent Pyrophosphorolysis Reaction Screening a F279H TdT Variant for Improved by-Product Profiles TdT SEQ ID NO: 3958 was selected for shake flask purification and screening against by-products including those formed, for example, by a TdT-dependent pyrophosphorolysis reaction. The shake flasks expressing SEQ ID NO: 3488 and SEQ ID NO: 3958 were grown, lysed, and purified as described in Example 3.

Reactions were performed in 96-well format 200 μL BioRad PCR plates. Reactions included 1 μM oligonucleotide, 25 μM nucleotide triphosphate, 20 mM MOPS, 50 mM potassium acetate, and 250 μM cobalt (II) chloride. The reactions were set up as follows: (i) all reaction components, except for TdT were pre-mixed in a single solution, and 15 μL of this solution was aliquoted into each well of the 96-well plate; (ii) 5 μL of TdT solution (4× concentration in 20 mM MOPS, pH 7.2) was then added into the wells to initiate the reaction. The reaction plate was heat-sealed with a peelable aluminum seal and incubated in a thermocycler at the indicated temperature and reaction time, followed by a 2-minute heat-kill at 95° C. and then held at 4° C. until the reaction was quenched. Reaction and quench details are specified in Table 109.1. Supernatant was then transferred into new HTP plates for analytical analysis. For analysis of the reaction samples, capillary electrophoresis was performed using an ABI 3500xl Genetic Analyzer (ThermoFisher). See example 73 for method details.

TABLE 109.1

| Reaction, quench, and analytical properties |
|---|
| Reaction conditions: Oligonucleotide—1 μM 5'-6-FAM-TTTTTTTTTTTTTTTTTATC or 5'-6-FAM-FAM-TTTTTTTTTTTTTTTTTGTT; Nucleotide triphosphate—25 μM 3'PO4-dGTP; Reaction buffer—20 mM MOPS, pH 7.2, 50 mM potassium acetate, 250 μM cobalt (II) chloride; Adjuvant concentration (if present)—none; Reaction volume—20 μL; TdT concentration—1 μM; Reaction temperature—60° C.; Reaction time—1.5 minutes |
| Quench conditions: Quench solution and volume—Reactions were quenched by the addition of 60 μL of 35 mM aqueous EDTA. After thorough mixing, 5 μL of the quenched reaction solution was further diluted in 995 μL of water, and 2 μL of this solution was transferred to a new plate containing 18 μL HI-DI formamide with sizing ladder; Plate type—96-well MicroAmp Optical PCR plate |
| Analytical conditions: Instrument—ABI (Thermo) 3500XL—see details above; Reaction products detected—Reaction 1: 5'-6-FAM-TTTTTTTTTTTTTTTTTATC (substrate), 5'-6-FAM- |

TABLE 109.1-continued

| Reaction, quench, and analytical properties |
| --- |
| TTTTTTTTTTTTTTTTTATCG-3'PO4 (product), Reaction 2: 5'-6-FAM-TTTTTTTTTTTTTTTTTGTT (substrate), 5'-6-FAM-TTTTTTTTTTTTTTTTTGTTG-3'PO4 (product) |

Percent product and by-product were calculated as the peak area of product or summed peak areas of by-products divided by the summed area of all peaks in the electropherogram above a peak amplitude threshold of 25 multiplied by 100. The ratio of the percent product to percent by-products was calculated for each variant and compared with the equivalent product/by-product ratio observed for SEQ ID NO: 3488 (where fold-improvement-over-parent or FIOP is equal to the product/by-product ratio of the variant divided by the product/by-product ratio of SEQ ID NO: 3488). The results are shown in Tables 109.2-109.3.

TABLE 109.2

| (condition 1, ATC, G) | | |
| --- | --- | --- |
| SEQ ID NO: (nt/aa) | Amino Acid Differences (Relative to SEQ ID NO: 3488) | FIOP % Product/ % By-Product Relative to SEQ ID NO: 3488 |
| 3957/3958 | F279H | + |

Levels of increased activity were determined relative to the reference polypeptide of SEQ ID NO: 3488 and defined as follows: "+" > 1.50

TABLE 109.3

| (condition 2, GTT, G) | | |
| --- | --- | --- |
| SEQ ID NO: (nt/aa) | Amino Acid Differences (Relative to SEQ ID NO: 3488) | FIOP % Product/ % By-Product Relative to SEQ ID NO: 3488 |
| 3957/3958 | F279H | + |

Levels of increased activity were determined relative to the reference polypeptide of SEQ ID NO: 3488 and defined as follows: "+" > 1.50

Example 110

Screening of Shake-Flask Purified TdTs for Improvements Over SEQ ID NO: 5296 in the Extension of Oligonucleotide Acceptor Molecules with Nucleotide Triphosphate Donors Screening of Purified TdTs for Improved Variants TdT SEQ ID NO: 5624 and SEQ ID NO: 5300 were selected for shake flask purification and screened for activity improvements. The shake flasks expressing SEQ ID NO: 5296, SEQ ID NO: 5624 and TdT SEQ ID NO: 5300 were grown, lysed, and purified as described in Example 3.

Reactions were performed in 96-well format 200 TL BioRad PCR plates. Reactions included 1 μM oligonucleotide, 10 μM nucleotide triphosphate, 20 mM MOPS, 50 mM potassium acetate, 5% formamide, 0.6% PEG 3350, and 250 (IM cobalt (II) chloride. The reactions were set up as follows: (i) all reaction components, except for TdT were pre-mixed in a single solution, and 15 μL of this solution was aliquoted into each well of the 96-well plate; (ii) 5 μL of TdT solution (4× concentration in 20 mM MOPS, pH 7.2) was then added into the wells to initiate the reaction. The reaction plate was heat-sealed with a peelable aluminum seal and incubated in a thermocycler at the indicated temperature and reaction time, followed by a 2-minute heat-kill at 95° C. and then held at 4° C. until the reaction was quenched. Reaction and quench details are specified in Table 110.1. Supernatant was then transferred into new HTP plates for analytical analysis. For analysis of the reaction samples, capillary electrophoresis was performed using an ABI 3500xl Genetic Analyzer (ThermoFisher). See example 73 for method details.

TABLE 110.1

| Reaction, quench, and analytical properties |
| --- |
| Reaction conditions: Oligonucleotide—1 uM 5'-6-FAM-TTTTTTTTTTTTTTTTTGGA or 5'-6-FAM-FAM-TTTTTTTTTTTTTTTTTTCGT or 5'-6-FAM-FAM-TTTTTTTTTTTTTTTTTTCCG; Nucleotide triphosphate—10 μM 3'PO4-dTTP; Reaction buffer—20 mM MOPS, pH 7.2, 50 mM potassium acetate, 250 μM cobalt (II) chloride; Adjuvant concentration (if present)—5% formamide, 0.6% PEG 3350; Reaction volume—20 μL; TdT concentration—1 μM; Reaction temperature—60° C.; Reaction time—45 seconds |
| Quench conditions: Quench solution and volume—Reactions were quenched by the addition of 60 μL of 35 mM aqueous EDTA. After thorough mixing, 5 μL of the quenched reaction solution was further diluted in 995 μL of water, and 2 μL of this solution was transferred to a new plate containing 18 μL HI-DI formamide with sizing ladder; Plate type—96-well MicroAmp Optical PCR plate |
| Analytical conditions: Instrument—ABI (Thermo) 3500XL—see details above; Reaction products detected—Reaction 1: 5'-6-FAM-TTTTTTTTTTTTTTTTTGGA (substrate), 5'-6-FAM-TTTTTTTTTTTTTTTTTGGAT-3'PO4 (product), Reaction 2: 5'-6-FAM-TTTTTTTTTTTTTTTTTTCGT (substrate), 5'-6-FAM-TTTTTTTTTTTTTTTTTTCGTT-3'PO4 (product), Reaction 3: 5'-6-FAM-TTTTTTTTTTTTTTTTTTCCG (substrate), 5'-6-FAM-TTTTTTTTTTTTTTTTTCCGT-3'PO4 (product) |

Percent product calculated as the peak area of product divided by the summed area of all peaks in the electropherogram above a peak amplitude threshold of 25 multiplied by 100. The results are shown in Tables 110.2-110.4.

TABLE 110.2

| (condition 1, GGA, T) | | |
|---|---|---|
| SEQ ID NO: (nt/aa) | Amino Acid Differences (Relative to SEQ ID NO: 5296) | FIOP % Product Relative to SEQ ID NO: 5296 |
| 5623/5624 | C68R | + |
| 5299/5300 | R154L/E187D/M220Q/E350I/Y386F | + |

Levels of increased activity were determined relative to the reference polypeptide of SEQ ID NO: 5296 and defined as follows: "+" > 1.30

TABLE 110.3

| (condition 2, CGT, T) | | |
|---|---|---|
| SEQ ID NO: (nt/aa) | Amino Acid Differences (Relative to SEQ ID NO: 5296) | FIOP % Product Relative to SEQ ID NO: 5296 |
| 5623/5624 | C68R | + |
| 5299/5300 | R154L/E187D/M220Q/E350I/Y386F | + |

Levels of increased activity were determined relative to the reference polypeptide of SEQ ID NO: 5296 and defined as follows: "+" > 1.20

TABLE 110.4

| (condition 3, CCG, T) | | |
|---|---|---|
| SEQ ID NO: (nt/aa) | Amino Acid Differences (Relative to SEQ ID NO: 5296) | FIOP % Product Relative to SEQ ID NO: 5296 |
| 5623/5624 | C68R | + |
| 5299/5300 | R154L/E187D/M220Q/E350I/Y386F | + |

Levels of increased activity were determined relative to the reference polypeptide of SEQ ID NO: 5296 and defined as follows: "+" > 1.30

Example 111

Screening of Shake-Flask Purified TdTs for Improvements Over SEQ ID NO: 5624 in the Extension of Oligonucleotide Acceptor Molecules with Nucleotide Triphosphate Donors Screening of Purified TdTs for Improved Variants TdT SEQ ID NO: 5624, SEQ ID NO: 5626, SEQ ID NO: 5628, SEQ ID NO: 5630, SEQ ID NO: 5632, SEQ ID NO: 5634, SEQ ID NO: 5636, SEQ ID NO: 5638 were selected for shake flask purification and screened for activity improvements. The shake flasks expressing SEQ ID NO: 5624, SEQ ID NO: 5626, SEQ ID NO: 5628, SEQ ID NO: 5630, SEQ ID NO: 5632, SEQ ID NO: 5634, SEQ ID NO: 5636, SEQ ID NO: 5638 were grown, lysed, and purified as described in Example 3.

Reactions were performed in 96-well format 200 μL BioRad PCR plates. Reactions included 1 μM oligonucleotide, 5 μM nucleotide triphosphate, 20 mM MOPS, 50 mM potassium acetate, 5% formamide, 0.6% PEG 3350, and 250 μM cobalt (11) chloride. The reactions were set up as follows: (i) all reaction components, except for TdT were pre-mixed in a single solution, and 15 μL of this solution was aliquoted into each well of the 96-well plate; (ii) 5 μL of TdT solution (4× concentration in 20 mM MOPS, pH 7.2) was then added into the wells to initiate the reaction. The reaction plate was heat-sealed with a peelable aluminum seal and incubated in a thermocycler at the indicated temperature and reaction time, followed by a 2-minute heat-kill at 95° C. and then held at 4° C. until the reaction was quenched. Reaction and quench details are specified in Table 111.1. Supernatant was then transferred into new HTP plates for analytical analysis. For analysis of the reaction samples, capillary electrophoresis was performed using an ABI 3500xl Genetic Analyzer (ThermoFisher). See example 73 for method details.

TABLE 111.1

| Reaction, quench, and analytical properties |
|---|
| Reaction conditions: Oligonucleotide—1 μM 5'-6-FAM-TTTTTTTTTTTTTTTTTGCC or 5'-6-FAM-FAM-TTTTTTTTTTTTTTTTTGGA; Nucleotide triphosphate—5 μM 3'PO4-dTTP; Reaction buffer—20 mM MOPS, pH 7.2, 50 mM potassium acetate, 250 μM cobalt (II) chloride; Adjuvant concentration (if present)—5% formamide, 0.6% PEG 3350; Reaction volume—20 μL; TdT concentration—1 μM; Reaction temperature—65° C.; Reaction time—20 seconds |
| Quench conditions: Quench solution and volume—Reactions were quenched by the addition of 60 μL of 35 mM aqueous EDTA. After thorough mixing, 5 μL of the quenched reaction solution was further diluted in 995 μL of water, and 2 μL of this solution was transferred to a new plate containing 18 μL HI-DI formamide with sizing ladder; Plate type—96-well MicroAmp Optical PCR plate |
| Analytical conditions: Instrument—ABI (Thermo) 3500XL—see details above; Reaction products detected—Reaction 1: 5'-6-FAM-TTTTTTTTTTTTTTTTTGCC (substrate), 5'-6-FAM-TTTTTTTTTTTTTTTTTGCCT-3'PO4 (product), Reaction 2: 5'-6-FAM-TTTTTTTTTTTTTTTTTGGA (substrate), 5'-6-FAM-TTTTTTTTTTTTTTTTTGAAT-3'PO4 (product) |

Percent product calculated as the peak area of product divided by the summed area of all peaks in the electropherogram above a peak amplitude threshold of 25 multiplied by 100. The results are shown in Tables 111.2-111.3.

TABLE 111.2

| (condition 1, GCC, T) | | |
|---|---|---|
| SEQ ID NO: (nt/aa) | Amino Acid Differences (Relative to SEQ ID NO: 5624) | FIOP % Product Relative to SEQ ID NO: 5624 |
| 5625/5626 | R154L/M220Q/D237P/A275Q | + |
| 5627/5628 | S143A/R154L/M220Q/D237P/A275Q/S304V | + |
| 5629/5630 | S143A/R154L/A157V/S162F/M220Q/D237P/A275Q/S304V/L331K | + |
| 5631/5632 | S143A/R154L/A157V/S162F/S184T/A188K/R200W/S203D/A211V/M220Q/D237P/K242N/A275Q/S304V/L331K | ++ |
| 5633/5634 | S143A/R154L/A157V/S162F/S184T/A188K/R200W/S203D/A211V/M220Q/D237P/K242N/K272A/A275Q/S304V/L331K | + |
| 5635/5636 | S143A/R154L/A157V/S162F/S184T/A188K/R200W/S203D/A211V/G217R/M220Q/D237P/K242N/K272A/A275Q/N278G/S304V/L331K/E391Y | ++ |
| 5637/5638 | S143A/R154L/A157V/A159R/S162F/S184T/A188K/R200W/S203D/T209E/A211V/G217R/M220Q/D237P/K242N/K272A/A275Q/N278G/S304V/L331K/R352K/D353N/E391Y | +++ |

Levels of increased activity were determined relative to the reference polypeptide of SEQ ID NO: 5624 and defined as follows: "+" 1.05 to 1.22, "++" > 1.22, "+++" > 1.23

TABLE 111.3

| (condition 2, GGA, T) | | |
|---|---|---|
| SEQ ID NO: (nt/aa) | Amino Acid Differences (Relative to SEQ ID NO: 5624) | FIOP % Product Relative to SEQ ID NO: 5624 |
| 5625/5626 | R154L/M220Q/D237P/A275Q | + |
| 5627/5628 | S143A/R154L/M220Q/D237P/A275Q/S304V | + |
| 5629/5630 | S143A/R154L/A157V/S162F/M220Q/D237P/A275Q/S304V/L331K | + |
| 5631/5632 | S143A/R154L/A157V/S162F/S184T/A188K/R200W/S203D/A211V/M220Q/D237P/K242N/A275Q/S304V/L331K | + |
| 5633/5634 | S143A/R154L/A157V/S162F/S184T/A188K/R200W/S203D/A211V/M220Q/D237P/K242N/K272A/A275Q/S304V/L331K | ++ |
| 5635/5636 | S143A/R154L/A157V/S162F/S184T/A188K/R200W/S203D/A211V/G217R/M220Q/D237P/K242N/K272A/A275Q/N278G/S304V/L331K/E391Y | ++ |
| 5637/5638 | S143A/Rl 54L/A157V/A159R/S162F/S184T/A188K/R200W/S203D/T209E/A211V/G217R/M220Q/D237P/K242N/K272A/A275Q/N278G/S304V/L331K/R352K/D353N/E391Y | +++ |

Levels of increased activity were determined relative to the reference polypeptide of SEQ ID NO: 5624 and defined as follows: "+" 1.27 to 1.40, "++" > 1.40, "+++" > 1.76

While the invention has been described with reference to the specific embodiments, various changes can be made and equivalents can be substituted to adapt to a particular situation, material, composition of matter, process, process step or steps, thereby achieving benefits of the invention without departing from the scope of what is claimed.

For all purposes in the United States of America, each and every publication and patent document cited in this disclosure is incorporated herein by reference as if each such publication or document was specifically and individually indicated to be incorporated herein by reference. Citation of publications and patent documents is not intended as an indication that any such document is pertinent prior art, nor does it constitute an admission as to its contents or date.

SEQUENCE LISTING (6775 sequences)

SEQ ID NO: 1 - DNA, 1539 bp, synthetic construct
  misc_feature 1..1539: note = Orthologs of terminal deoxynucleotidyl transferase
  source 1..1539: mol_type = other DNA
atggataaaatcaaagcttcagctgttatctcccacaggaagagacagaaggggttacattcctcaaaactttcctgcacttatgaagtaaaatttcctaagtttgtaatttttattatgcagaggaagatgggggttaccagaaggatgtttttgacggagctggcaagaagaaaaggtttcagagtagaaagtgagctaagtgatgctgtcactcacattgtggctgagaacaactcttacttggaggtgctggactggctgaaaggacaggctgtgggtgacagctccaggtttgaactactggacatctcctggtttacagcctgcatggaagcaggaagaccagttgattcagaaatgaagtatcatctcatggtaagacagaagcatcctccttcaaatacaccagaattggaagtgccatcagttattgcaagaaaagtatctcagtattcgtgccagaggaagacaactttaaataactacaacaagaaattcacggatgcctttgagataatggccgaaaattatgagttcaaagaaaatgaaatattctgcctggaatttctgagggcagcttctttgctgaaatatcttccatttccagtaacccgaatgaaagatatacaagggttgccctgcataggagaccaagtcagagatgtcattgaggagattattgaagaaggagagagttctagagttaaagaagtgttaaatgatgagcgatacaaggcttttaagcaatttacttcagtctttggagtgggagtgaagacatctgagaaatggttcagaatgggtttgcgaacagtggaagagttaaaagctgacaagagcctcaagctgtccaaaatgcagaaagcagggtttctctactatgaggaccttgttagctgtgtatctaaggcagaagcagatgcagtaaccttgattgtcaagaataccgtatctacctttctaccagatgctttagttaccataacaggtggtttcaggaggggtaagaagatgggacatgacattgattttttgatcaccaatccaggaccaaaagaagatgatgaacttctgcataaagttgttgacttattgaaaaagcagggtttactcctatattgtgatatcattgaatcaacatttgtagaagaacaactaccaagcagaaagattgatgccatggataattttcagaagtgttttgcaattttaaaattatatcagccaggagtagacaacagcagttacaacacgtcaaaaaaatcggatatggcagaagtcaaagactggaaggcaatccgtgtggatctggtcataaccccctttgagcaatatgcatatgctctgttaggttggacaggctccagggaatttggacgtgatttgcggagatatgctagtcatgaaaggaagatgatattggataaccatgggttatatgacaggaaaaagcggatctttctcaaagctggaagtgaggaagaaatctttgcccatcttggcttggattatgttgaaccatgggaaagaaatgct

SEQ ID NO: 2 - protein, 513 aa, synthetic construct
  REGION 1..513: note = Orthologs of terminal deoxynucleotidyl transferase
MDKIKASAVISHRKRQKGLHSSKLSCTYEVKFPKFVIFIMQRKMGVTRRMFLTELARRKGFRVESELSDAVTHIVAENNSYLEVLDWLKGQAVGDSSRFELLDISWFTACMEAGRPVDSEMKYHLMVRQKHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 3 - DNA, 1182 bp, synthetic construct
  misc_feature 1..1182: note = Orthologs of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 4 - protein, 394 aa, synthetic construct
  REGION 1..394: note = Orthologs of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 5 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgggctgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 6 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDGLLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 7 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatctctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 8 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKSLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 9 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacgttagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 10 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNVSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 11 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgcgtgccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 12 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELRADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 13 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccggaggttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 14 - protein, 394 aa, synthetic construct
  REGION 1..394: note = Variant of terminal deoxynucleotidyl transferase
MHHHHHHGGSGHPPSNTPELEVPEVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 15 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagtctgaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 16 - protein, 394 aa, synthetic construct
  REGION 1..394: note = Variant of terminal deoxynucleotidyl transferase
MHHHHHHGGSGHPPSNTPESEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 17 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaatatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 18 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERNMILDNHGLYDRKKRIFLKAGSEEEIFAHLGLDYVEPWERNA

SEQ ID NO: 19 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcaagtgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 20 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIKCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 21 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatccgttgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 22 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIRCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 23 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggatgatagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 24 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDDSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 25 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgttctgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 26 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRSVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 27 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctgggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 28 - protein, 394 aa, synthetic construct
  REGION 1..394: note = Variant of terminal deoxynucleotidyl transferase
MHHHHHHGGSGHPPSNTPELGVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 29 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggattctagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 30 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDSSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 31 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaaggttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 32 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENERFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 33 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtggctacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 34 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVATFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 35 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacagtagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 36 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADSSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 37 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaacgtggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 38 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIERGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 39 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaaggggacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 40 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKGTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 41 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaagggctgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 42 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEGLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 43 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcggatagcgaagaagagattttcgcgcatctgggtctggattatgtggagccgtgggaacgcaacgcg

SEQ ID NO: 44 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKADSEEEIFAHLGLDYVEPWERNA

SEQ ID NO: 45 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgtttctctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 46 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVSLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 47 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcagtcaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 48 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGSQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 49 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgccagcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagttggacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 50 - protein, 394 aa, synthetic construct
  REGION 1..394: note = Variant of terminal deoxynucleotidyl transferase
MHHHHHHGGSGHPPSNTPELEVPSVIASKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKLDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 51 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcgagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 52 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSEMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 53 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgactgtatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 54 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDCIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 55 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagtttgaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 56 - protein, 394 aa, synthetic construct
  REGION 1..394: note = Variant of terminal deoxynucleotidyl transferase
MHHHHHHGGSGHPPSNTPEFEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 57 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgggcgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 58 - protein, 394 aa, synthetic construct
  REGION 1..394: note = Variant of terminal deoxynucleotidyl transferase
MHHHHHHGGSGHPPSNTPELEVPSVIGRKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 59 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggattggagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 60 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDWSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 61 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtgaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 62 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 63 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcgggaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 64 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGGKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 65 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaatggatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 66 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKWMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 67 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataggccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 68 - protein, 394 aa, synthetic construct
  REGION 1..394: note = Variant of terminal deoxynucleotidyl transferase
MHHHHHHGGSGHPPSNRPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 69 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgcaggttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 70 - protein, 394 aa, synthetic construct
  REGION 1..394: note = Variant of terminal deoxynucleotidyl transferase
MHHHHHHGGSGHPPSNTPELEVPQVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 71 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcctgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 72 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSLYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 73 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaagagccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 74 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQEPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 75 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 76 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 77 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagggtagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 78 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKGSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 79 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctgacgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 80 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLTSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 81 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacctggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 82 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDLAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 83 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccggtggttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 84 - protein, 394 aa, synthetic construct
  REGION 1..394: note = Variant of terminal deoxynucleotidyl transferase
MHHHHHHGGSGHPPSNTPELEVPVVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 85 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaagcgatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 86 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKAMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 87 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccgtcgctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 88 - protein, 394 aa, synthetic construct
  REGION 1..394: note = Variant of terminal deoxynucleotidyl transferase
MHHHHHHGGSGHPPSNTPSLEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 89 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataactcgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 90 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNSSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 91 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaacttttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 92 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENELFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 93 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaaggaggacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 94 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKEDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 95 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagtggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 96 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKVDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 97 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtaggtttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 98 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSRFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 99 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcattaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 100 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGIKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 101 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggcgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 102 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLASCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 103 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagtgggacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 104 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKWDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 105 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagcaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 106 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQQAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 107 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 108 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 109 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaagagttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 110 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEEFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 111 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagatgatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 112 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKDDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 113 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagacgcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 114 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKTQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 115 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcaggcgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 116 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESRRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 117 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaagctttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 118 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEAFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 119 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtcgtgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 120 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRRVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 121 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaaagtgatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 122 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKSDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 123 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccggggagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 124 - protein, 394 aa, synthetic construct
  REGION 1..394: note = Variant of terminal deoxynucleotidyl transferase
MHHHHHHGGSGHPGSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 125 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaagttggacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 126 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKLDKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 127 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgaggacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 128 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVRTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 129 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagtgtatctttctgaaagcgggcagcgaagaagagattttcgcgcatctgggtctggattatgtggagccgtgggaacgcaacgcg

SEQ ID NO: 130 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKCIFLKAGSEEEIFAHLGLDYVEPWERNA

SEQ ID NO: 131 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggccagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 132 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGQSSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 133 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaacgtatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 134 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKRMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 135 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagatccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 136 - protein, 394 aa, synthetic construct
  REGION 1..394: note = Variant of terminal deoxynucleotidyl transferase
MHHHHHHGGSGHPPSNTPELEDPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 137 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcgcttataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 138 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSAYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 139 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtgtggagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 140 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASVERKMILDNHGLYDRKKRIFLKAGSEEEIFAHLGLDYVEPWERNA

SEQ ID NO: 141 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcaggaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 142 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGRKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 143 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatctatcgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 144 - protein, 394 aa, synthetic construct
  REGION 1..394: note = Variant of terminal deoxynucleotidyl transferase
MHHHHHHGGSGHPPSNTPELEVPSVIYRKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 145 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttcaggctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 146 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 147 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcgtgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 148 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVIVPFEQYAYALLGWTGSREFGRDLRRYASHERKMILDNHGLYDRKKRIFLKAGSEEEIFAHLGLDYVEPWERNA

SEQ ID NO: 149 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggatgttagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 150 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDVSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 151 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcattgccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 152 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIIAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 153 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaagggacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 154 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKRDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 155 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtacggggacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 156 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYGDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 157 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcgtttataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 158 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSVYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 159 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagattaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 160 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEEIKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 161 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatccttgccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 162 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEILAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 163 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtacgaggacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 164 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYEDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 165 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacctctatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 166 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTSMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 167 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcaattgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 168 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEINCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 169 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 170 - protein, 394 aa, synthetic construct; identical to SEQ ID NO: 146
  REGION 1..394: note = Variant of terminal deoxynucleotidyl transferase

SEQ ID NO: 171 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggctaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 172 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEEAKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 173 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaaactggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 174 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIETGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 175 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccaacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactggagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 176 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKANKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNWSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 177 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcctttaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 178 - protein, 394 aa, synthetic construct
  REGION 1..394: note = Variant of terminal deoxynucleotidyl transferase
MHHHHHHGGSGHPPSNTPELEVPSVIAFKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 179 - DNA, 1182 bp, synthetic construct; identical to SEQ ID NO: 33
  misc_feature 1..1182: note = Variant of terminal deoxynucleotidyl transferase
  source 1..1182: mol_type = other DNA

SEQ ID NO: 180 - protein, 394 aa, synthetic construct; identical to SEQ ID NO: 34
  REGION 1..394: note = Variant of terminal deoxynucleotidyl transferase

SEQ ID NO: 181 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgcgtagcgaagaagagattttcgcgcatctgggtctggattatgtggagccgtgggaacgcaacgcg

SEQ ID NO: 182 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKARSEEEIFAHLGLDYVEPWERNA

SEQ ID NO: 183 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagggaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 184 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKGNEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 185 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 186 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 187 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcgattgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 188 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIDCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 189 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtcagggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 190 - protein, 394 aa, synthetic construct
  REGION 1..394: note = Variant of terminal deoxynucleotidyl transferase
MHHHHHHGGQGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 191 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcacgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 192 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSTYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 193 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaagttttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 194 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEVFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 195 - DNA, 1182 bp, synthetic construct; identical to SEQ ID NO: 43
  misc_feature 1..1182: note = Variant of terminal deoxynucleotidyl transferase
  source 1..1182: mol_type = other DNA

SEQ ID NO: 196 - protein, 394 aa, synthetic construct; identical to SEQ ID NO: 44
  REGION 1..394: note = Variant of terminal deoxynucleotidyl transferase

SEQ ID NO: 197 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcgcttgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 198 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIACLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 199 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttcatgaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 200 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVHEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 201 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttatggagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 202 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFMENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 203 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggatgtgagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 204 - protein, 394 aa, synthetic construct; identical to SEQ ID NO: 150
  REGION 1..394: note = Variant of terminal deoxynucleotidyl transferase

SEQ ID NO: 205 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaacctatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 206 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKPMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 207 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcctctaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 208 - protein, 394 aa, synthetic construct
  REGION 1..394: note = Variant of terminal deoxynucleotidyl transferase
MHHHHHHGGSGHPPSNTPELEVPSVIASKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 209 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccacgaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 210 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKATKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 211 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatccgtgagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 212 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIREIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 213 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgaggtgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 214 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVRCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 215 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgattgtctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 216 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDCLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 217 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacgggagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 218 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNGSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 219 - DNA, 1182 bp, synthetic construct; identical to SEQ ID NO: 57
  misc_feature 1..1182: note = Variant of terminal deoxynucleotidyl transferase
  source 1..1182: mol_type = other DNA

SEQ ID NO: 220 - protein, 394 aa, synthetic construct; identical to SEQ ID NO: 58
  REGION 1..394: note = Variant of terminal deoxynucleotidyl transferase

SEQ ID NO: 221 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggggcgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 222 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAGRVDLVITPFEQYAYALLGWTGSREFGRDLRRYASHERKMILDNHGLYDRKKRIFLKAGSEEEIFAHLGLDYVEPWERNA

SEQ ID NO: 223 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagagtgaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 224 - protein, 394 aa, synthetic construct; identical to SEQ ID NO: 16
  REGION 1..394: note = Variant of terminal deoxynucleotidyl transferase

SEQ ID NO: 225 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacggctgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 226 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTAVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 227 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtcatgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 228 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRHVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 229 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggcctgtaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 230 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKACKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 231 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaaggagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 232 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKEFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 233 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaatgatccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 234 - protein, 394 aa, synthetic construct
  REGION 1..394: note = Variant of terminal deoxynucleotidyl transferase
MHHHHHHGGSGHPPSNDPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 235 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggtttctgagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 236 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVSELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 237 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattactcggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 238 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYSDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 239 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgagtgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 240 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPSVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 241 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggcttgctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 242 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGLLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 243 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggtgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 244 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEEVKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 245 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtagggcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 246 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSRAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 247 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggccctcaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 248 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGPQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 249 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaacaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 250 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKQDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 251 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaagtgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 252 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQVPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 253 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttggagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 254 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDALEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 255 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcgcgatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 256 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERAMILDNHGLYDRKKRIFLKAGSEEEIFAHLGLDYVEPWERNA

SEQ ID NO: 257 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataaccggagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 258 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNRSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 259 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgtatgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 260 - protein, 394 aa, synthetic construct
  REGION 1..394: note = Variant of terminal deoxynucleotidyl transferase
MHHHHHHGGSGHPPSNTPELEVPYVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 261 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactggagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 262 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNWSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 263 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatcgggaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 264 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDRELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 265 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatgattgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 266 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMIEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 267 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagcggctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 268 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKRLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 269 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcggtatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 270 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRGIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 271 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatccggccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 272 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVIRPFEQYAYALLGWTGSREFGRDLRRYASHERKMILDNHGLYDRKKRIFLKAGSEEEIFAHLGLDYVEPWERNA

SEQ ID NO: 273 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttctgtaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 274 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFCKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 275 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaagccgagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 276 - protein, 394 aa, synthetic construct
  REGION 1..394: note = Variant of terminal deoxynucleotidyl transferase
MHHHHHHGGSGHPPSNTPELEVPSVIARKPSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 277 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactatagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 278 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNYSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 279 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcccgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 280 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSPYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 281 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcggttgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 282 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIGCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 283 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgattgcgggcagcgaagaagagattttcgcgcatctgggtctggattatgtggagccgtgggaacgcaacgcg

SEQ ID NO: 284 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLIAGSEEEIFAHLGLDYVEPWERNA

SEQ ID NO: 285 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtgatggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 286 - protein, 394 aa, synthetic construct
  REGION 1..394: note = Variant of terminal deoxynucleotidyl transferase
MHHHHHHGGDGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 287 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagccgtcatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 288 - protein, 394 aa, synthetic construct
  REGION 1..394: note = Variant of terminal deoxynucleotidyl transferase
MHHHHHHGGSRHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 289 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctggggcagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 290 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLGQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 291 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatgttctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 292 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDVLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 293 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagtttgggacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 294 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVWDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 295 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgacggttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 296 - protein, 394 aa, synthetic construct
  REGION 1..394: note = Variant of terminal deoxynucleotidyl transferase
MHHHHHHGGSGHPPSNTPELEVPTVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 297 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagccggaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 298 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSRKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 299 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatcatgggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 300 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIMGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 301 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgtggatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 302 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTWIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 303 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatggagctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 304 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMELDNHGLYDRKKRIFLKAGSEEEIFAHLGLDYVEPWERNA

SEQ ID NO: 305 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccatggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 306 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAMVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 307 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcacggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 308 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFTVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 309 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaagtgctgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 310 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEVLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 311 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgcggtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 312 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRAVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 313 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtatcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 314 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWYRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 315 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgaatagcgaagaagagattttcgcgcatctgggtctggattatgtggagccgtgggaacgcaacgcg

SEQ ID NO: 316 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKANSEEEIFAHLGLDYVEPWERNA

SEQ ID NO: 317 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtacccggacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 318 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYPDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 319 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaggagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 320 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADRSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 321 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacttgctgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 322 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDLLLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 323 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttcacgctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 324 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFTLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 325 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctcgataaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 326 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLDKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 327 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcaaggtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 328 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLKVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 329 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgaccttagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 330 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADLSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 331 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataaccggagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 332 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNRSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 333 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgggtacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 334 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVGTPFEQYAYALLGWTGSREFGRDLRRYASHERKMILDNHGLYDRKKRIFLKAGSEEEIFAHLGLDYVEPWERNA

SEQ ID NO: 335 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagcagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 336 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKQQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 337 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctgaggagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 338 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLRSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 339 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttttggagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 340 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFLENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 341 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttcagtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 342 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFSLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 343 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgacgaactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 344 - protein, 394 aa, synthetic construct
  REGION 1..394: note = Variant of terminal deoxynucleotidyl transferase
MHHHHHHGGSGHPPSNTPELEVPSVIARKVSQYSCQRKTTLTNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 345 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgccgtaagcgcatctttctgaaagcgggcagcgaagaagagattttcgcgcatctgggtctggattatgtggagccgtgggaacgcaacgcg

SEQ ID NO: 346 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRRKRIFLKAGSEEEIFAHLGLDYVEPWERNA

SEQ ID NO: 347 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaatttctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 348 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEFLKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 349 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctctctgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 350 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLSDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 351 - DNA, 1182 bp, synthetic construct; identical to SEQ ID NO: 225
  misc_feature 1..1182: note = Variant of terminal deoxynucleotidyl transferase
  source 1..1182: mol_type = other DNA

SEQ ID NO: 352 - protein, 394 aa, synthetic construct; identical to SEQ ID NO: 226
  REGION 1..394: note = Variant of terminal deoxynucleotidyl transferase

SEQ ID NO: 353 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaccgcgcatctttctgaaagcgggcagcgaagaagagattttcgcgcatctgggtctggattatgtggagccgtgggaacgcaacgcg

SEQ ID NO: 354 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKPRIFLKAGSEEEIFAHLGLDYVEPWERNA

SEQ ID NO: 355 - DNA, 1182 bp, synthetic construct; identical to SEQ ID NO: 193
  misc_feature 1..1182: note = Variant of terminal deoxynucleotidyl transferase
  source 1..1182: mol_type = other DNA

SEQ ID NO: 356 - protein, 394 aa, synthetic construct; identical to SEQ ID NO: 194
  REGION 1..394: note = Variant of terminal deoxynucleotidyl transferase

SEQ ID NO: 357 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagaagggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 358 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQKGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 359 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtaattttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 360 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSNFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 361 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacggggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgcaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 362 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNGVSTFLPDALVTITGGFRRGKKMGHDIDFLITNPGPKEDDELLHKVVDLLKKQGLLLYCDIIESTFVEEQLPSRKIDAMDNFQKCFAILKLHQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 363 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagtcgacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 364 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKSTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 365 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtttgtttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 366 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSLFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 367 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaatctggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 368 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIESGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 369 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcaggatgcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 370 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQDAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 371 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgtgtccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 372 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITCPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 373 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgaaggtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 374 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTKVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 375 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtgggggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 376 - protein, 394 aa, synthetic construct
  REGION 1..394: note = Variant of terminal deoxynucleotidyl transferase
MHHHHHHGGGGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 377 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttctggcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 378 - protein, 394 aa, synthetic construct
  REGION 1..394: note = Variant of terminal deoxynucleotidyl transferase
MHHHHHHGGSGHPPSNTPELEVPSVLARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 379 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgtgtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 380 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVCTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 381 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctggattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 382 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLDYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 383 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtcttgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 384 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRLVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 385 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtcaggtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 386 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRQVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 387 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtacaagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 388 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYKPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 389 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaaattggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 390 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEIGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 391 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtctcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 392 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWSRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 393 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatcagtggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 394 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDISGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 395 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatggcggacatccaaggtctgccgtgcattggcgaccaagttcgtgacgtgatcgaggagatcatcgaagaaggcgagagcagccgcgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 396 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMADIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 397 - DNA, 1182 bp, synthetic construct
  misc_feature 1..1182: note = Variant of terminal deoxynucleotidyl transferase
  source 1..1182: mol_type = other DNA
atgcaccatcatcatcatcatccgggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 398 - protein, 394 aa, synthetic construct
  REGION 1..394: note = Variant of terminal deoxynucleotidyl transferase
MHHHHHHPGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 399 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtgcgaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 400 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSAKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 401 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaaacgcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 402 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQTRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 403 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaatttttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 404 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKIFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 405 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcaggttcgtggaggaacaactgccaagtcgcaaaatcgacgccatggacaacttccagaagtgcttcgccattctcaagctgtaccagccaggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 406 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESRFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 407 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaaatgggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 408 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEMGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 409 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggttgcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 410 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWLRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 411 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaatggctgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 412 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEWLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 413 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttctatgaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 414 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFYEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 415 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattgcgaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 416 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAIAKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 417 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacggggatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 418 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTGIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 419 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgctggaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 420 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPLEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 421 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttaggtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 422 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFRYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 423 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcgataagcgcatctttctgaaagcgggcagcgaagaagagattttcgcgcatctgggtctggattatgtggagccgtgggaacgcaacgcg

SEQ ID NO: 424 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRDKRIFLKAGSEEEIFAHLGLDYVEPWERNA

SEQ ID NO: 425 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgaatacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 426 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVNTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 427 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacggggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 428 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNGVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 429 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttatggaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctactcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 430 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVMEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 431 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcttggaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 432 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEILEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 433 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaccggacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 434 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKPDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 435 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgactatctgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 436 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDYLLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 437 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtgttctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 438 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASVLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 439 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagttatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 440 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASYERKMILDNHGLYDRKKRIFLKAGSEEEIFAHLGLDYVEPWERNA

SEQ ID NO: 441 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtcggaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 442 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSRKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 443 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatcgatggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 444 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIDGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 445 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgcggcagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 446 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLRQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 447 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtggagacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 448 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVETPFEQYAYALLGWTGSREFGRDLRRYASHERKMILDNHGLYDRKKRIFLKAGSEEEIFAHLGLDYVEPWERNA

SEQ ID NO: 449 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagcattgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 450 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSIVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 451 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaagatctgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 452 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEDLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 453 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagaccttcaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 454 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDLQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 455 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatctgtgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 456 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEICEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 457 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggggagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 458 - protein, 394 aa, synthetic construct
  REGION 1..394: note = Variant of terminal deoxynucleotidyl transferase
MHHHHHHGGSGHPPSNTPELEVPSVIARKGSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 459 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaatcgctgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 460 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEESLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 461 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggatgctagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 462 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDASSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 463 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgctgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 464 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEAAAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 465 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaggctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 466 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLRLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 467 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagctgttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 468 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKLFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 469 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtaccattgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 470 - protein, 394 aa, synthetic construct
  REGION 1..394: note = Variant of terminal deoxynucleotidyl transferase
MHHHHHHGGSGHPPSNTPELEVPSVIARKVSQYHCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 471 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataacgataacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 472 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNDNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 473 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaagggatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 474 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKGMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 475 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgggggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 476 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDAGVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 477 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagcagggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 478 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQQGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 479 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggctgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctatgtgacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 480 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYVTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 481 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgctttatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 482 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERFMILDNHGLYDRKKRIFLKAGSEEEIFAHLGLDYVEPWERNA

SEQ ID NO: 483 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggctgtagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 484 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGCSSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 485 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcttgtttctgaaagcgggcagcgaagaagagattttcgcgcatctgggtctggattatgtggagccgtgggaacgcaacgcg

SEQ ID NO: 486 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRLFLKAGSEEEIFAHLGLDYVEPWERNA

SEQ ID NO: 487 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaacaggacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 488 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKQDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 489 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgggtaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 490 - protein, 394 aa, synthetic construct
  REGION 1..394: note = Variant of terminal deoxynucleotidyl transferase
MHHHHHHGGSGHPPGNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 491 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaaaggctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 492 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKRLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 493 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaaactctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 494 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKTLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 495 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgagctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 496 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVELLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 497 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaaggctgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 498 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKADMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 499 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaaggtccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 500 - protein, 394 aa, synthetic construct
  REGION 1..394: note = Variant of terminal deoxynucleotidyl transferase
MHHHHHHGGSGHPPSNTPELEGPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 501 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacagtatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 502 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDSIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 503 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttgatcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 504 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFDRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 505 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccggccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 506 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYRPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 507 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagcgggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 508 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEAGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 509 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgaatgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 510 - protein, 394 aa, synthetic construct
  REGION 1..394: note = Variant of terminal deoxynucleotidyl transferase
MHHHHHHGGSGHPPSNTPELEVPNVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 511 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccggttgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 512 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPVVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 513 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatggggagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 514 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNGERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 515 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatgtctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 516 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKCLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 517 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaacctggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccactatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 518 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEPGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRHYASHERKMILDNHGLYDRKKRIFLKAGSEEEIFAHLGLDYVEPWERNA

SEQ ID NO: 519 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcactgaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 520 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFTEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 521 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgtttctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 522 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMFLDNHGLYDRKKRIFLKAGSEEEIFAHLGLDYVEPWERNA

SEQ ID NO: 523 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcgagcgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 524 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESERVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 525 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgtttaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 526 - protein, 394 aa, synthetic construct
  REGION 1..394: note = Variant of terminal deoxynucleotidyl transferase
MHHHHHHGGSGHPPFNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 527 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagaaggacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 528 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKKDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 529 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgtttatctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 530 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVYLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 531 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttctttattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 532 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFFILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 533 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgctttatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 534 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCFIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 535 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacttgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 536 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNLSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 537 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggtttggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 538 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKVWKAIRVDLVITPFEQYAYALLGWTGSREFGRDLRRYASHERKMILDNHGLYDRKKRIFLKAGSEEEIFAHLGLDYVEPWERNA

SEQ ID NO: 539 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccctgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 540 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSPVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 541 - DNA, 1182 bp, synthetic construct
  misc_feature 1..1182: note = Variant of terminal deoxynucleotidyl transferase
  source 1..1182: mol_type = other DNA
atgcaccatcatcatcatcataggggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 542 - protein, 394 aa, synthetic construct
  REGION 1..394: note = Variant of terminal deoxynucleotidyl transferase
MHHHHHHRGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 543 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacggcgatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 544 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTAIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 545 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagaataccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 546 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKNTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 547 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgactcgctgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 548 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDSLLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 549 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagcttatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 550 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFELMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 551 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaagggctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 552 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKGLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 553 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcttgcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 554 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFLQYAYALLGWTGSREFGRDLRRYASHERKMILDNHGLYDRKKRIFLKAGSEEEIFAHLGLDYVEPWERNA

SEQ ID NO: 555 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgaggtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 556 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVREVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 557 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctggatctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 558 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLDLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 559 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttggggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 560 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVGDWKAIRVDLVITPFEQYAYALLGWTGSREFGRDLRRYASHERKMILDNHGLYDRKKRIFLKAGSEEEIFAHLGLDYVEPWERNA

SEQ ID NO: 561 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcgttaccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 562 - protein, 394 aa, synthetic construct
  REGION 1..394: note = Variant of terminal deoxynucleotidyl transferase
MHHHHHHGGSGHPPSVTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 563 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtgaggagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 564 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASEERKMILDNHGLYDRKKRIFLKAGSEEEIFAHLGLDYVEPWERNA

SEQ ID NO: 565 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcgggttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 566 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESGFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 567 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtgcagccgtgggaacgcaacgcg

SEQ ID NO: 568 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVQPWERNA

SEQ ID NO: 569 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacaagtttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 570 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYKFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 571 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacaagtttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcaaggagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 572 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYKFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 573 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacaagtttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggaccacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 574 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYKFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDHFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 575 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgagtttaaagagaacaaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatccaggagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 576 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENKIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIQESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 577 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagagtgaggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtagtgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggccagctgcgttagtaaagcggaagccgatgccgttacgctcatcgtgaagaacacggtggcgacctttctgccggatgcgctggtgaccatcacgggcggtttccgccgtggcaaaaagatgggccacgacatcgactttctgatcacgaatccgggcccaaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 578 - protein, 394 aa, synthetic construct
  REGION 1..394: note = Variant of terminal deoxynucleotidyl transferase
MHHHHHHGGSGHPPSNTPESEVPSVIARKVSQYSCQRKTTLNNYNKKFTDAFEIMAENYEFKENEIFRLEFLRAASLLKYLPFPVTRMKDIQGLPCIGDQVRSVIEEIIEEGESSRVKEVLNDERYKAFKQFTSVFGVGVKTSEKWFRMGLRTVEELKADKSLKLSKMQKAGFLYYEDLASCVSKAEADAVTLIVKNTVATFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 579 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 580 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 581 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagagtgaggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgatgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtggcgacctttctgccggatgcgctggtgaccatcacgggcggtttccgccgtggcaaaaagatgggccacgacatcgactttctgatcacgaatccgggcccgaaagaggatgacgggctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactcgtcgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 582 - protein, 394 aa, synthetic construct
  REGION 1..394: note = Variant of terminal deoxynucleotidyl transferase
MHHHHHHGGSGHPPSNTPESEVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVATFLPDALVTITGGFRRGKKMGHDIDFLITNPGPKEDDGLLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 583 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctgggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactcggcgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 584 - protein, 394 aa, synthetic construct
  REGION 1..394: note = Variant of terminal deoxynucleotidyl transferase
MHHHHHHGGSGHPPSNTPELGVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSAYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 585 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgacgtgatcgaggagatcatcgaacgtggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtcagctgcgttagtaaagcggaagccgatgccgttacgctcatcgtgaagaacacggtggcgacctttctgccggatgcgctggtgaccatcacgggcggtttccgccgtggcaaaaagatgggccacgacatcgactttctgatcacgaatccgggcccaaaagaggatgacgggctgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactcgtcgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 586 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFRLEFLRAASLLKYLPFPVTRMKDIQGLPCIGDQVRDVIEEIIERGESSRVKEVLNDERYKAFKQFTSVFGVGVKTSEKWFRMGLRTVEELKADKSLKLSKMQKAGFLYYEDLVSCVSKAEADAVTLIVKNTVATFLPDALVTITGGFRRGKKMGHDIDFLITNPGPKEDDGLLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 587 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctgggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggccagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccaaaaagtgatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 588 - protein, 394 aa, synthetic construct
  REGION 1..394: note = Variant of terminal deoxynucleotidyl transferase
MHHHHHHGGSGHPPSNTPELGVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLASCVSKAEADAVTLIVKNTVSTFLPDALVTITGGFRRGKKMGHDIDFLITNPGPKSDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 589 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagagtgaggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgatgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccaaaaagtgatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactcggcgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 590 - protein, 394 aa, synthetic construct
  REGION 1..394: note = Variant of terminal deoxynucleotidyl transferase
MHHHHHHGGSGHPPSNTPESEVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLVSCVSKAEADAVTLIVKNTVSTFLPDALVTITGGFRRGKKMGHDIDFLITNPGPKSDDELLHKVVDLLKKQGLLLYCDIIESTFVEEQLPSRKIDAMDNFQKCFAILKLYQPGVDNSAYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 591 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagagtgaggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgatgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcggcaaaagtgatgacgaactgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactcgtcgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 592 - protein, 394 aa, synthetic construct
  REGION 1..394: note = Variant of terminal deoxynucleotidyl transferase
MHHHHHHGGSGHPPSNTPESEVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVSTFLPDALVTITGGFRRGKKMGHDIDFLITNPGGKSDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 593 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaacgtggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtcagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 594 - protein, 394 aa, synthetic construct; identical to SEQ ID NO: 38
  REGION 1..394: note = Variant of terminal deoxynucleotidyl transferase

SEQ ID NO: 595 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagagtgaggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactcgtcgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 596 - protein, 394 aa, synthetic construct
  REGION 1..394: note = Variant of terminal deoxynucleotidyl transferase
MHHHHHHGGSGHPPSNTPESEVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 597 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctgggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgatgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 598 - protein, 394 aa, synthetic construct
  REGION 1..394: note = Variant of terminal deoxynucleotidyl transferase
MHHHHHHGGSGHPPSNTPELGVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVRTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 599 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagagtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcggcaaagaggatgacgaactgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactcggcgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 600 - protein, 394 aa, synthetic construct
  REGION 1..394: note = Variant of terminal deoxynucleotidyl transferase
MHHHHHHGGSGHPPSNTPESGVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGGKEDDELLHKVVDGLKKQGLLLYCDIIESTFVEEQLPSRKIDAMDNFQKCFAILKLYQPGVDNSAYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 601 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagagtgaggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 602 - protein, 394 aa, synthetic construct
  REGION 1..394: note = Variant of terminal deoxynucleotidyl transferase
MHHHHHHGGSGHPPSNTPESEVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLVSCVSKAEADAVTLIVKNTVSTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 603 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctgggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgacgtgatcgaggagatcatcgaacgtggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtcagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactcgtcgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 604 - protein, 394 aa, synthetic construct
  REGION 1..394: note = Variant of terminal deoxynucleotidyl transferase
MHHHHHHGGSGHPPSNTPELGVPSVIARKVSQYSCQRKTTLNNYNKKFTDAFEIMAENYEFKENEIFRLEFLRAASLLKYLPFPVTRMKDIQGLPCIGDQVRDVIEEIIERGESSRVKEVLNDERYKAFKQFTSVFGVGVKTSEKWFRMGLRTVEELKADKSLKLSKMQKAGFLYYEDLVSCVSKAEADAVTLIVKNTVRTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 605 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagagtgaggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtagtgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccaaaaagtgatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 606 - protein, 394 aa, synthetic construct
  REGION 1..394: note = Variant of terminal deoxynucleotidyl transferase
MHHHHHHGGSGHPPSNTPESEVPSVIARKVSQYSCQRKTTLNNYNKKFTDAFEIMAENYEFKENEIFCLEFLRAASLLKYLPFPVTRMKDIQGLPCIGDQVRSVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKSDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 607 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctgggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggtcagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgggctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactcgtcgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 608 - protein, 394 aa, synthetic construct
  REGION 1..394: note = Variant of terminal deoxynucleotidyl transferase
MHHHHHHGGSGHPPSNTPELGVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLVSCVSKAEADAVTLIVKNTVSTFLPDALVTITGGFRRGKKMGHDIDFLITNPGPKEDDGLLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 609 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggccagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccaaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 610 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLASCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 611 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgtcgacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 612 - protein, 394 aa, synthetic construct; identical to SEQ ID NO: 146
  REGION 1..394: note = Variant of terminal deoxynucleotidyl transferase

SEQ ID NO: 613 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtagtgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtcagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccaaaaagtgatgacgaactgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactcggcgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 614 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFRLEFLRAASLLKYLPFPVTRMKDIQGLPCIGDQVRSVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVRTFLPDALVTITGGFRRGKKMGHDIDFLITNPGPKSDDELLHKVVDGLKKQGLLLYCDIIESTFVEEQLPSRKIDAMDNFQKCFAILKLYQPGVDNSAYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 615 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagagtgaggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgatgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgtcgacctttctgccggatgcgctggtgaccatcacgggcggtttccgccgtggcaaaaagatgggccacgacatcgactttctgatcacgaatccgggcccaaaaagtgatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactcggcgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 616 - protein, 394 aa, synthetic construct
  REGION 1..394: note = Variant of terminal deoxynucleotidyl transferase
MHHHHHHGGSGHPPSNTPESEVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKSDDELLHKVVDLLKKQGLLLYCDIIESTFVEEQLPSRKIDAMDNFQKCFAILKLYQPGVDNSAYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 617 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctgggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggccagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactcgtcgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 618 - protein, 394 aa, synthetic construct
  REGION 1..394: note = Variant of terminal deoxynucleotidyl transferase
MHHHHHHGGSGHPPSNTPELGVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLASCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 619 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtagtgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgggctgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactcggcgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 620 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIFRLEFLRAASLLKYLPFPVTRMKDIQGLPCIGDQVRSVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVRTFLPDALVTITGGFRRGKKMGHDIDFLITNPGPKEDDGLLHKVVDLLKKQGLLLYCDIIESTFVEEQLPSRKIDAMDNFQKCFAILKLYQPGVDNSAYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 621 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagagtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgatgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtcagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccaaaaagtgatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactcggcgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 622 - protein, 394 aa, synthetic construct
  REGION 1..394: note = Variant of terminal deoxynucleotidyl transferase
MHHHHHHGGSGHPPSNTPESGVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVRTFLPDALVTITGGFRRGKKMGHDIDFLITNPGPKSDDELLHKVVDLLKKQGLLLYCDIIESTFVEEQLPSRKIDAMDNFQKCFAILKLYQPGVDNSAYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 623 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctgggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 624 - protein, 394 aa, synthetic construct
  REGION 1..394: note = Variant of terminal deoxynucleotidyl transferase
MHHHHHHGGSGHPPSNTPELGVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 625 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctgggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgatgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggccagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactcgtcgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 626 - protein, 394 aa, synthetic construct
  REGION 1..394: note = Variant of terminal deoxynucleotidyl transferase
MHHHHHHGGSGHPPSNTPELGVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLASCVSKAEADAVTLIVKNTVSTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 627 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtagtgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcggcaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 628 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRSVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGGKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 629 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtagtgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactcgtcgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 630 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRSVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 631 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaacgtggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggtcagctgcgttagtaaagcggaagccgatgccgttacgctcatcgtgaagaacacggtggcgacctttctgccggatgcgctggtgaccatcacgggcggtttccgccgtggcaaaaagatgggccacgacatcgactttctgatcacgaatccgggcccaaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactcgtcgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 632 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIFCLEFLRAASLLKYLPFPVTRMKDIQGLPCIGDQVRDVIEEIIERGESSRVKEVLNDERYKAFKQFTSVFGVGVKTSEKWFRMGLRTVEELKASKSLKLSKMQKAGFLYYEDLVSCVSKAEADAVTLIVKNTVATFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 633 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagagtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgatgtgatcgaggagatcatcgaacgtggcgagagcagccgtgttaaagaagttctcaatgacgagcgatacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtcagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccaaaaagtgatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactcgtcgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 634 - protein, 394 aa, synthetic construct
  REGION 1..394: note = Variant of terminal deoxynucleotidyl transferase
MHHHHHHGGSGHPPSNTPESGVPSVIARKVSQYSCQRKTTLNNYNKKFTDAFEIMAENYEFKENEIFRLEFLRAASLLKYLPFPVTRMKDIQGLPCIGDQVRDVIEEIIERGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKSDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 635 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtagtgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggtgagctgcgttagtaaagcggaagccgatgccgttacgctcatcgtgaagaacacggtgtcgacctttctgccggatgcgctggtgaccatcacgggcggtttccgccgtggcaaaaagatgggccacgacatcgactttctgatcacgaatccgggcccaaaaagtgatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 636 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFRLEFLRAASLLKYLPFPVTRMKDIQGLPCIGDQVRSVIEEIIEEGESSRVKEVLNDERYKAFKQFTSVFGVGVKTSEKWFRMGLRTVEELKASKSLKLSKMQKAGFLYYEDLVSCVSKAEADAVTLIVKNTVSTFLPDALVTITGGFRRGKKMGHDIDFLITNPGPKSDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 637 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggccagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccaaaaagtgatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactcgtcgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 638 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLASCVSKAEADAVTLIVKNTVSTFLPDALVTITGGFRRGKKMGHDIDFLITNPGPKSDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 639 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgatgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggccagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccaaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactcggcgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 640 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLASCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSAYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 641 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagagtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtagtgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcggcaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 642 - protein, 394 aa, synthetic construct
  REGION 1..394: note = Variant of terminal deoxynucleotidyl transferase
MHHHHHHGGSGHPPSNTPESGVPSVIARKVSQYSCQRKTTLNNYNKKFTDAFEIMAENYEFKENEIFCLEFLRAASLLKYLPFPVTRMKDIQGLPCIGDQVRSVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGGKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 643 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtgaggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactcgtcgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 644 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 645 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagagtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgatgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggtgagctgcgttagtaaagcggaagccgatgccgttacgctcatcgtgaagaacacggtgtcgacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 646 - protein, 394 aa, synthetic construct
  REGION 1..394: note = Variant of terminal deoxynucleotidyl transferase
MHHHHHHGGSGHPPSNTPESGVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 647 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcggcaaagaggatgacgaactgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 648 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLVSCVSKAEADAVTLIVKNTVSTFLPDALVTITGGFRRGKKMGHDIDFLITNPGGKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 649 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctgggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggtgagctgcgttagtaaagcggaagccgatgccgttacgctcatcgtgaagaacacggtgtcgacctttctgccggatgcgctggtgaccatcacgggcggtttccgccgtggcaaaaagatgggccacgacatcgactttctgatcacgaatccgggcccgaaagaggatgacgggctgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactcgtcgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 650 - protein, 394 aa, synthetic construct
  REGION 1..394: note = Variant of terminal deoxynucleotidyl transferase
MHHHHHHGGSGHPPSNTPELGVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLVSCVSKAEADAVTLIVKNTVSTFLPDALVTITGGFRRGKKMGHDIDFLITNPGPKEDDGLLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 651 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctgggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtagtgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtcagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcggcaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactcgtcgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 652 - protein, 394 aa, synthetic construct
  REGION 1..394: note = Variant of terminal deoxynucleotidyl transferase
MHHHHHHGGSGHPPSNTPELGVPSVIARKVSQYSCQRKTTLNNYNKKFTDAFEIMAENYEFKENEIFCLEFLRAASLLKYLPFPVTRMKDIQGLPCIGDQVRSVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGGKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 653 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgatgtgatcgaggagatcatcgaacgtggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcggcaaagagaatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactcggcgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 654 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFRLEFLRAASLLKYLPFPVTRMKDIQGLPCIGDQVRDVIEEIIERGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGGKENDELLHKVVDLLKKQGLLLYCDIIESTFVEEQLPSRKIDAMDNFQKCFAILKLYQPGVDNSAYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 655 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagagtgaggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtagtgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgtcgacctttctgccggatgcgctggtgaccatcacgggcggtttccgccgtggcaaaaagatgggccacgacatcgactttctgatcacgaatccgggcggcaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 656 - protein, 394 aa, synthetic construct
  REGION 1..394: note = Variant of terminal deoxynucleotidyl transferase
MHHHHHHGGSGHPPSNTPESEVPSVIARKVSQYSCQRKTTLNNYNKKFTDAFEIMAENYEFKENEIFCLEFLRAASLLKYLPFPVTRMKDIQGLPCIGDQVRSVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGGKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 657 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctgggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcggcaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactcggcgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 658 - protein, 394 aa, synthetic construct
  REGION 1..394: note = Variant of terminal deoxynucleotidyl transferase
MHHHHHHGGSGHPPSNTPELGVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGGKEDDELLHKVVDLLKKQGLLLYCDIIESTFVEEQLPSRKIDAMDNFQKCFAILKLYQPGVDNSAYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 659 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagagtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaacgtggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtcagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgggctgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 660 - protein, 394 aa, synthetic construct
  REGION 1..394: note = Variant of terminal deoxynucleotidyl transferase
MHHHHHHGGSGHPPSNTPESGVPSVIARKVSQYSCQRKTTLNNYNKKFTDAFEIMAENYEFKENEIFCLEFLRAASLLKYLPFPVTRMKDIQGLPCIGDQVRDVIEEIIERGESSRVKEVLNDERYKAFKQFTSVFGVGVKTSEKWFRMGLRTVEELKADKSLKLSKMQKAGFLYYEDLVSCVSKAEADAVTLIVKNTVRTFLPDALVTITGGFRRGKKMGHDIDFLITNPGPKEDDGLLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 661 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagagtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaacgtggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 662 - protein, 394 aa, synthetic construct
  REGION 1..394: note = Variant of terminal deoxynucleotidyl transferase
MHHHHHHGGSGHPPSNTPESGVPSVIARKVSQYSCQRKTTLNNYNKKFTDAFEIMAENYEFKENEIFCLEFLRAASLLKYLPFPVTRMKDIQGLPCIGDQVRDVIEEIIERGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 663 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagagtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 664 - protein, 394 aa, synthetic construct
  REGION 1..394: note = Variant of terminal deoxynucleotidyl transferase
MHHHHHHGGSGHPPSNTPESGVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLVSCVSKAEADAVTLIVKNTVSTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 665 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctgggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtagtgtgatcgaggagatcatcgaacgtggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgtcgacctttctgccggatgcgctggtgaccatcacgggcggtttccgccgtggcaaaaagatgggccacgacatcgactttctgatcacgaatccgggcccaaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactcgtcgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 666 - protein, 394 aa, synthetic construct
  REGION 1..394: note = Variant of terminal deoxynucleotidyl transferase
MHHHHHHGGSGHPPSNTPELGVPSVIARKVSQYSCQRKTTLNNYNKKFTDAFEIMAENYEFKENEIFRLEFLRAASLLKYLPFPVTRMKDIQGLPCIGDQVRSVIEEIIERGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 667 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgatgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcggcaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 668 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGGKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 669 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaagtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtagtgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggtcagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccaaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactcggcgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 670 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRSVIEEIIEEGESSRVKEVLNDERYKAFKQFTSVFGVGVKTSEKWFRMGLRTVEELKASKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSAYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 671 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctgggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccaaaaagtgatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 672 - protein, 394 aa, synthetic construct
  REGION 1..394: note = Variant of terminal deoxynucleotidyl transferase
MHHHHHHGGSGHPPSNTPELGVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKSDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 673 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtggcgacctttctgccggatgcgctggtgaccatcacgggcggtttccgccgtggcaaaaagatgggccacgacatcgactttctgatcacgaatccgggcccaaaaagtgatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactcggcgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 674 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLVSCVSKAEADAVTLIVKNTVATFLPDALVTITGGFRRGKKMGHDIDFLITNPGPKSDDELLHKVVDLLKKQGLLLYCDIIESTFVEEQLPSRKIDAMDNFQKCFAILKLYQPGVDNSAYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 675 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgatgtgatcgaggagatcatcgaacgtggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggtcagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcggcaaaagtgatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactcggcgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 676 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYEFKENEIFCLEFLRAASLLKYLPFPVTRMKDIQGLPCIGDQVRDVIEEIIERGESSRVKEVLNDERYKAFKQFTSVFGVGVKTSEKWFRMGLRTVEELKASKSLKLSKMQKAGFLYYEDLVSCVSKAEADAVTLIVKNTVSTFLPDALVTITGGFRRGKKMGHDIDFLITNPGGKSDDELLHKVVDLLKKQGLLLYCDIIESTFVEEQLPSRKIDAMDNFQKCFAILKLYQPGVDNSAYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 677 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtagtgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtcagctgcgttagtaaagcggaagccgatgccgttacgctcatcgtgaagaacacggtgtcgacctttctgccggatgcgctggtgaccatcacgggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 678 - protein, 394 aa, synthetic construct; identical to SEQ ID NO: 26
  REGION 1..394: note = Variant of terminal deoxynucleotidyl transferase

SEQ ID NO: 679 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtgaggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtagtgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggtgagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactcgtcgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 680 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDAFEIMAENYEFKENEIFRLEFLRAASLLKYLPFPVTRMKDIQGLPCIGDQVRSVIEEIIEEGESSRVKEVLNDERYKAFKQFTSVFGVGVKTSEKWFRMGLRTVEELKASKSLKLSKMQKAGFLYYEDLVSCVSKAEADAVTLIVKNTVRTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 681 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctgggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 682 - protein, 394 aa, synthetic construct; identical to SEQ ID NO: 28
  REGION 1..394: note = Variant of terminal deoxynucleotidyl transferase

SEQ ID NO: 683 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagagtgaggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaacgtggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 684 - protein, 394 aa, synthetic construct
  REGION 1..394: note = Variant of terminal deoxynucleotidyl transferase
MHHHHHHGGSGHPPSNTPESEVPSVIARKVSQYSCQRKTTLNNYNKKFTDAFEIMAENYEFKENEIFCLEFLRAASLLKYLPFPVTRMKDIQGLPCIGDQVRDVIEEIIERGESSRVKEVLNDERYKAFKQFTSVFGVGVKTSEKWFRMGLRTVEELKADKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 685 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctgggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggctgcgctggtgaccatcacgggcggtttccgccgtggcaaaaagatgggccacgacatcgactttctgatcacgaatccgggcccgaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactcggcgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 686 - protein, 394 aa, synthetic construct
  REGION 1..394: note = Variant of terminal deoxynucleotidyl transferase
MHHHHHHGGSGHPPSNTPELGVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPAALVTITGGFRRGKKMGHDIDFLITNPGPKEDDELLHKVVDLLKKQGLLLYCDIIESTFVEEQLPSRKIDAMDNFQKCFAILKLYQPGVDNSAYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 687 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagagtgaggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgatgtgatcgaggagatcatcgaacgtggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggccagctgcgttagtaaagcggaagccgatgccgttacgctcatcgtgaagaacacggtgtcgacctttctgccggatgcgctggtgaccatcacgggcggtttccgccgtggcaaaaagatgggccacgacatcgactttctgatcacgaatccgggcccaaaaagtgatgacgaactgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataactcggcgtataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 688 - protein, 394 aa, synthetic construct
  REGION 1..394: note = Variant of terminal deoxynucleotidyl transferase
MHHHHHHGGSGHPPSNTPESEVPSVIARKVSQYSCQRKTTLNNYNKKFTDAFEIMAENYEFKENEIFCLEFLRAASLLKYLPFPVTRMKDIQGLPCIGDQVRDVIEEIIERGESSRVKEVLNDERYKAFKQFTSVFGVGVKTSEKWFRMGLRTVEELKADKSLKLSKMQKAGFLYYEDLASCVSKAEADAVTLIVKNTVSTFLPDALVTITGGFRRGKKMGHDIDFLITNPGPKSDDELLHKVVDGLKKQGLLLYCDIIESTFVEEQLPSRKIDAMDNFQKCFAILKLYQPGVDNSAYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 689 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagagtgaggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccaaaagaggatgacgaactgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 690 - protein, 394 aa, synthetic construct; identical to SEQ ID NO: 16
  REGION 1..394: note = Variant of terminal deoxynucleotidyl transferase

SEQ ID NO: 691 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcgctcgtctggaatttctgcgcgccgcgagtctgctgaaatatctgccgttcccggttaccagtatgaaagacatccaaggtctgccgtgcattggcgaccaagttcgtgacgtgatcgaggagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 692 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIARLEFLRAASLLKYLPFPVTSMKDIQGLPCIGDQVRDVIEEIIETGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 693 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttaccagtatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagattaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 694 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIFRLEFLRAASLLKYLPFPVTSMKDIQGLPCIGDQVRDVIEEIIEEGESSRVKEVLNDERYKAFKQFTSVFGVGVKTSEKWFRMGLRTVEEIKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 695 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcatgcgtctggaatttctgcgcgccgcgagtctgctgaaatatctgccgttcccggttacccgtatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 696 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIMRLEFLRAASLLKYLPFPVTRMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 697 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttaccagtatgaaagacatccaaggtctgccgtgcattggcgaccaagttcgtgacgtgatcgaggagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagattaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 698 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIFRLEFLRAASLLKYLPFPVTSMKDIQGLPCIGDQVRDVIEEIIETGESSRVKEVLNDERYKAFKQFTSVFGVGVKTSEKWFRMGLRTVEEIKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 699 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcatgcgtctggaatttctgcgcgccgcgagtctgctgaaatatctgccgttcccggttacccgtatgaaagacatccaaggtctgccgtgcattggcgaccaagttcgtgacgtgatccgcgagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 700 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIMRLEFLRAASLLKYLPFPVTRMKDIQGLPCIGDQVRDVIREIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 701 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcctggccgagaactacgaatttaaagagaacgaaatctttcgtctggaatttctgcgcgccgcgagtctgctgaaatatctgccgttcccggttaccagtatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 702 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEILAENYEFKENEIFRLEFLRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 703 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttaccagtatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 704 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIFRLEFLRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 705 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttaccagtatgaaagacatccaaggtctgccgtgcattggcgaccaagttcgtgacgtgatcgaggagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 706 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIFRLEFLRAASLLKYLPFPVTSMKDIQGLPCIGDQVRDVIEEIIETGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 707 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcgctcgtctggaatttctgcgcgccgcgagtctgctgaaatatctgccgttcccggttaccagtatgaaagacatccaaggtctgccgtgcattggcgaccaagttcgtgacgtgatccgcgagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 708 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIARLEFLRAASLLKYLPFPVTSMKDIQGLPCIGDQVRDVIREIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 709 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcctggccgagaactacgaatttaaagagaacgaaatcgatcgtctggaatttctgcgcgccgcgagtctgctgaaatatctgccgttcccggttaccagtatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagattaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 710 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEILAENYEFKENEIDRLEFLRAASLLKYLPFPVTSMKDIQGLPCIGDQVRDVIEEIIEEGESSRVKEVLNDERYKAFKQFTSVFGVGVKTSEKWFRMGLRTVEEIKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 711 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcatgcgtctggaatttctgcgcgccgcgagtctgctgaaatatctgccgttcccggttaccagtatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 712 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIMRLEFLRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 713 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttaccagtatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagattaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 714 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIFRLEFLRAASLLKYLPFPVTSMKDIQGLPCIGDQVRDVIEEIIEEGESSRVKEVLNDERYKAFKQFTSVFGVGVKTSEKWFRMGLRTVEEIKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 715 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgtatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagattaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 716 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEEIKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 717 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcgctcgtctggaatttctgcgcgccgcgagtctgctgaaatatctgccgttcccggttacccgtatgaaagacatccaaggtctgccgtgcattggcgaccaagttcgtgacgtgatcgaggagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 718 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIARLEFLRAASLLKYLPFPVTRMKDIQGLPCIGDQVRDVIEEIIETGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 719 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatctttcgtctggaatttctgcgcgccgcgagtctgctgaaatatctgccgttcccggttaccagtatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 720 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIFRLEFLRAASLLKYLPFPVTSMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 721 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcctggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgacgtgatccgcgagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagattaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 722 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEILAENYEFKENEIFRLEFLRAASLLKYLPFPVTRMKDIQGLPCIGDQVRDVIREIIEEGESSRVKEVLNDERYKAFKQFTSVFGVGVKTSEKWFRMGLRTVEEIKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 723 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatctttcgtctggaatttctgcgcgccgcgagtctgctgaaatatctgccgttcccggttaccagtatgaaagacatccaaggtctgccgtgcattggcgaccaagttcgtgacgtgatccgcgagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 724 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIFRLEFLRAASLLKYLPFPVTSMKDIQGLPCIGDQVRDVIREIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 725 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcatgcgtctggaatttctgcgcgccgcgagtctgctgaaatatctgccgttcccggttaccagtatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagattaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 726 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIMRLEFLRAASLLKYLPFPVTSMKDIQGLPCIGDQVRDVIEEIIEEGESSRVKEVLNDERYKAFKQFTSVFGVGVKTSEKWFRMGLRTVEEIKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 727 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcatgcgtctggaatttctgcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 728 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIMRLEFLRAASLLKYLPFPVTRMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 729 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcctggccgagaactacgaatttaaagagaacgaaatcgctcgtctggaatttctgcgcgccgcgagtctgctgaaatatctgccgttcccggttacccgtatgaaagacatccaaggtctgccgtgcattggcgaccaagttcgtgacgtgatccgcgagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagattaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 730 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEILAENYEFKENEIARLEFLRAASLLKYLPFPVTRMKDIQGLPCIGDQVRDVIREIIETGESSRVKEVLNDERYKAFKQFTSVFGVGVKTSEKWFRMGLRTVEEIKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 731 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatctttcgtctggaatttctgcgcgccgcgagtctgctgaaatatctgccgttcccggttacccgtatgaaagacatccaaggtctgccgtgcattggcgaccaagttcgtgacgtgatccgcgagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagattaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 732 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIFRLEFLRAASLLKYLPFPVTRMKDIQGLPCIGDQVRDVIREIIETGESSRVKEVLNDERYKAFKQFTSVFGVGVKTSEKWFRMGLRTVEEIKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 733 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcgctcgtctggaatttctgcgcgccgcgagtctgctgaaatatctgccgttcccggttacccgtatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagattaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 734 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIARLEFLRAASLLKYLPFPVTRMKDIQGLPCIGDQVRDVIEEIIEEGESSRVKEVLNDERYKAFKQFTSVFGVGVKTSEKWFRMGLRTVEEIKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 735 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagattaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 736 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEEIKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 737 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcatgcgtctggaatttctgcgcgccgcgagtctgctgaaatatctgccgttcccggttaccagtatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 738 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIMRLEFLRAASLLKYLPFPVTSMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 739 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcctggccgagaactacgaatttaaagagaacgaaatcgatcgtctggaatttctgcgcgccgcgagtctgctgaaatatctgccgttcccggttacccgtatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtagatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 740 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEILAENYEFKENEIDRLEFLRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 741 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcctggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagattaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 742 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEILAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEEIKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 743 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcctggccgagaactacgaatttaaagagaacgaaatcatgcgtctggaatttctgcgcgccgcgagtctgctgaaatatctgccgttcccggttacccgcatgaaagacatccaaggtctgccgtgcattggcgaccaagttcgtgacgtgatccgcgagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 744 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEILAENYEFKENEIMRLEFLRAASLLKYLPFPVTRMKDIQGLPCIGDQVRDVIREIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 745 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcctggccgagaactacgaatttaaagagaacgaaatcgctcgtctggaatttctgcgcgccgcgagtctgctgaaatatctgccgttcccggttacccgcatgaaagacatccaaggtctgccgtgcattggcgaccaagttcgtgacgtgatcgaggagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 746 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEILAENYEFKENEIARLEFLRAASLLKYLPFPVTRMKDIQGLPCIGDQVRDVIEEIIETGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 747 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcctggccgagaactacgaatttaaagagaacgaaatcttccgtctggaatttctgcgcgccgcgagtctgctgaaatatctgccgttcccggttaccagtatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagattaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 748 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEILAENYEFKENEIFRLEFLRAASLLKYLPFPVTSMKDIQGLPCIGDQVRDVIEEIIEEGESSRVKEVLNDERYKAFKQFTSVFGVGVKTSEKWFRMGLRTVEEIKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 749 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 750 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 751 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgtatgaaagacatccaaggtctgccgtgcattggcgaccaagttcgtgacgtgatccgcgagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 752 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIFRLEFLRAASLLKYLPFPVTRMKDIQGLPCIGDQVRDVIREIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 753 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcctggccgagaactacgaatttaaagagaacgaaatcgctcgtctggaatttctgcgcgccgcgagtctgctgaaatatctgccgttcccggttacccgtatgaaagacatccaaggtctgccgtgcattggcgaccaagttcgtgacgtgatcgaggagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 754 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEILAENYEFKENEIARLEFLRAASLLKYLPFPVTRMKDIQGLPCIGDQVRDVIEEIIETGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 755 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcctggccgagaactacgaatttaaagagaacgaaatcaaccgtctggaatttctgcgcgccgcgagtctgctgaaatatctgccgttcccggttaccagtatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 756 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEILAENYEFKENEINRLEFLRAASLLKYLPFPVTSMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 757 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcaaccgtctggaatttctgcgcgccgcgagtctgctgaaatatctgccgttcccggttaccagtatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 758 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEINRLEFLRAASLLKYLPFPVTSMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 759 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcctggccgagaactacgaatttaaagagaacgaaatcaaccgtctggaatttctgcgcgccgcgagtctgctgaaatatctgccgttcccggttaccagtatgaaagacatccaaggtctgccgtgcattggcgaccaagttcgtgacgtgatccgcgagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 760 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEILAENYEFKENEINRLEFLRAASLLKYLPFPVTSMKDIQGLPCIGDQVRDVIREIIETGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 761 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatctttcgtctggaatttctgcgcgccgcgagtctgctgaaatatctgccgttcccggttacccgtatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 762 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 763 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcgctcgtctggaatttctgcgcgccgcgagtctgctgaaatatctgccgttcccggttacccgtatgaaagacatccaaggtctgccgtgcattggcgaccaagttcgtgacgtgatccgcgagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 764 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIARLEFLRAASLLKYLPFPVTRMKDIQGLPCIGDQVRDVIREIIETGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 765 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcatgcgtctggaatttctgcgcgccgcgagtctgctgaaatatctgccgttcccggttacccgcatgaaagacatccaaggtctgccgtgcattggcgaccaagttcgtgacgtgatcgaggagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 766 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIMRLEFLRAASLLKYLPFPVTRMKDIQGLPCIGDQVRDVIEEIIETGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 767 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcatgcgtctggaatttctgcgcgccgcgagtctgctgaaatatctgccgttcccggttacccgtatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 768 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIMRLEFLRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 769 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcctggccgagaactacgaatttaaagagaacgaaatcgatcgtctggaatttctgcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 770 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEILAENYEFKENEIDRLEFLRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 771 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcaaccgtctggaatttctgcgcgccgcgagtctgctgaaatatctgccgttcccggttacccgtatgaaagacatccaaggtctgccgtgcattggcgaccaagttcgtgacgtgatccgcgagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 772 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEINRLEFLRAASLLKYLPFPVTRMKDIQGLPCIGDQVRDVIREIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 773 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcgatcgtctggaatttctgcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 774 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIDRLEFLRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 775 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcctggccgagaactacgaatttaaagagaacgaaatcttccgtctggaatttctgcgcgccgcgagtctgctgaaatatctgccgttcccggttacccgtatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 776 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEILAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 777 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcctggccgagaactacgaatttaaagagaacgaaatcttccgtctggaatttctgcgcgccgcgagtctgctgaaatatctgccgttcccggttaccagtatgaaagacatccaaggtctgccgtgcattggcgaccaagttcgtgacgtgatccgcgagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 778 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEILAENYEFKENEIFRLEFLRAASLLKYLPFPVTSMKDIQGLPCIGDQVRDVIREIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 779 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcaaccgtctggaatttctgcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 780 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEINRLEFLRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 781 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcctggccgagaactacgaatttaaagagaacgaaatcatgcgtctggaatttctgcgcgccgcgagtctgctgaaatatctgccgttcccggttaccagtatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 782 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEILAENYEFKENEIMRLEFLRAASLLKYLPFPVTSMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 783 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcctggccgagaactacgaatttaaagagaacgaaatctttcgtctggaatttctgcgcgccgcgagtctgctgaaatatctgccgttcccggttaccagtatgaaagacatccaaggtctgccgtgcattggcgaccaagttcgtgacgtgatccgcgagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 784 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEILAENYEFKENEIFRLEFLRAASLLKYLPFPVTSMKDIQGLPCIGDQVRDVIREIIETGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 785 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcctggccgagaactacgaatttaaagagaacgaaatctttcgtctggaatttctgcgcgccgcgagtctgctgaaatatctgccgttcccggttacccgtatgaaagacatccaaggtctgccgtgcattggcgaccaagttcgtgacgtgatccgcgagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 786 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEILAENYEFKENEIFRLEFLRAASLLKYLPFPVTRMKDIQGLPCIGDQVRDVIREIIETGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 787 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcaaccgtctggaatttctgcgcgccgcgagtctgctgaaatatctgccgttcccggttacccgcatgaaagacatccaaggtctgccgtgcattggcgaccaagttcgtgacgtgatccgcgagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 788 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEINRLEFLRAASLLKYLPFPVTRMKDIQGLPCIGDQVRDVIREIIETGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 789 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcctggccgagaactacgaatttaaagagaacgaaatcttccgtctggaatttctgcgcgccgcgagtctgctgaaatatctgccgttcccggttaccagtatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 790 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEILAENYEFKENEIFRLEFLRAASLLKYLPFPVTSMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 791 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcctggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgacgtgatcgaggagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 792 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEILAENYEFKENEIFRLEFLRAASLLKYLPFPVTRMKDIQGLPCIGDQVRDVIEEIIETGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 793 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcgatcgtctggaatttctgcgcgccgcgagtctgctgaaatatctgccgttcccggttacccgcatgaaagacatccaaggtctgccgtgcattggcgaccaagttcgtgacgtgatcgaggagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 794 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIDRLEFLRAASLLKYLPFPVTRMKDIQGLPCIGDQVRDVIEEIIETGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 795 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcctggccgagaactacgaatttaaagagaacgaaatctttcgtctggaatttctgcgcgccgcgagtctgctgaaatatctgccgttcccggttacccgtatgaaagacatccaaggtctgccgtgcattggcgaccaagttcgtgacgtgatcgaggagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 796 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEILAENYEFKENEIFRLEFLRAASLLKYLPFPVTRMKDIQGLPCIGDQVRDVIEEIIETGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 797 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcctggccgagaactacgaatttaaagagaacgaaatctttcgtctggaatttctgcgcgccgcgagtctgctgaaatatctgccgttcccggttaccagtatgaaagacatccaaggtctgccgtgcattggcgaccaagttcgtgacgtgatccgcgagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 798 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEILAENYEFKENEIFRLEFLRAASLLKYLPFPVTSMKDIQGLPCIGDQVRDVIREIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 799 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcaaccgtctggaatttctgcgcgccgcgagtctgctgaaatatctgccgttcccggttaccagtatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 800 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEINRLEFLRAASLLKYLPFPVTSMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 801 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcctggccgagaactacgaatttaaagagaacgaaatcttccgtctggaatttctgcgcgccgcgagtctgctgaaatatctgccgttcccggttaccagtatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagattaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgcaggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 802 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEILAENYEFKENEIFRLEFLRAASLLKYLPFPVTSMKDIQGLPCIGDQVRDVIEEIIEEGESSRVKEVLNDERYKAFKQFTSVFGVGVKTSEKWFRMGLRTVEEIKASKSLKLSKMQKAGFLYYEDLASCVSKAEADAVTLIVKNTVRTFLPDAQVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 803 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgacgtgatccgcgagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 804 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIFRLEFLRAASLLKYLPFPVTRMKDIQGLPCIGDQVRDVIREIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 805 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcgctcgtctggaatttctgcgcgccgcgagtctgctgaaatatctgccgttcccggttacccgtatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 806 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIARLEFLRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 807 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttaccagtatgaaagacatccaaggtctgccgtgcattggcgaccaagttcgtgacgtgatccgcgagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 808 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIFRLEFLRAASLLKYLPFPVTSMKDIQGLPCIGDQVRDVIREIIETGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 809 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttaccagtatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 810 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIFRLEFLRAASLLKYLPFPVTSMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 811 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcctggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 812 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEILAENYEFKENEIFRLEFLRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 813 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactatgagtttaacgagaacgaaatcttctgtctggaatttctgcgcgccgcgagtctgctgaaatatctgccgttcccggttacccgcatgaaagacattcaaggtctgccgtgcattggcgaccaagttcgtgacgtgatcgaggagatcatcgaatatggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 814 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFNENEIFCLEFLRAASLLKYLPFPVTRMKDIQGLPCIGDQVRDVIEEIIEYGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 815 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacattcaaggtctgccgtgcattggcgaccaagttcgtgacgtgatcgaggagatcatcgaatatggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 816 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIFRLEFLRAASLLKYLPFPVTRMKDIQGLPCIGDQVRDVIEEIIEYGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 817 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtatcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccctgacgggcggtttccgccgtggcaaaaagatgggccacgacatcgactttctgatcacgaatccgggcccgggtgaggatgacgaactgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 818 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIFRLEFLRAASLLKYLPFPVTRMKDIQGLPCIGDQVRDVIEEIIEEGESSRVKEVLNDERYKAFKQFTSVFGVGVKTSEKWYRMGLRTVEELKASKSLKLSKMQKAGFLYYEDLASCVSKAEADAVTLIVKNTVRTFLPDALVTLTGGFRRGKKMGHDIDFLITNPGPGEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 819 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactatgagtttaacgggaacgaaatcttctgtctggaatttctgcgcgccgcgagtctgctgaaatatctgccgttcccggttacccgcatgaaagacctgcaaggtctgccgtgcattggcgaccaagttcgtgacgtgatcgaggagatcctggaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggacgcgctggtgaccctgacgggcggtttccgccgtggcaaaaagatgggccacgacatcgactttctgatcacgaatccgggcccgaaagaggatgacgaactgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 820 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFNGNEIFCLEFLRAASLLKYLPFPVTRMKDLQGLPCIGDQVRDVIEEILEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTLTGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 821 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactatgagtttaacgggaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 822 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFNGNEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 823 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactatgtgtttaacgagaacgaaatcttctgtctggaatttctgcgcgccgcgagtctgctgaaatatctgccgttcccggttacccgcatgaaagacctgcaaggtctgccgtgcattggcgaccaagttcgtgacgtgatcgaggagatcatcgaatatggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggacgcgctggtgaccatcacgggcggtttccgccgtggcaaaaagatgggccacgacatcgactttctgatcacgaatccgggcccgggtgaggatgacgaactgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgcctcagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 824 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYVFNENEIFCLEFLRAASLLKYLPFPVTRMKDLQGLPCIGDQVRDVIEEIIEYGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPGEDDELLHKVVDGLKKQGLLLYCDIIESTFVEEQLPSRKIDAMDNFQKCFAILKLPQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 825 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactatgagtttaacgggaacgaaatcttctgtctggaatttctgcgcgccgcgagtctgctgaaatatctgccgttcccggttacccgcatgaaagacctgcaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtatcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccgggcgcgctggtgaccctgacgggcggtttccgccgtggcaaaaagatgggccacgacatcgactttctgatcacgaatccgggcccgggtgaggatgacgaactgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 826 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFNGNEIFCLEFLRAASLLKYLPFPVTRMKDLQGLPCIGDQVRDVIEEIIEEGESSRVKEVLNDERYKAFKQFTSVFGVGVKTSEKWYRMGLRTVEELKASKSLKLSKMQKAGFLYYEDLASCVSKAEADAVTLIVKNTVRTFLPGALVTLTGGFRRGKKMGHDIDFLITNPGPGEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 827 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacattcaaggtctgccgtgcattggcgaccaagttcgtgacgtgatcgaggagatcctggaatatggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccgggcgcgctggtgaccctgacgggcggtttccgccgtggcaaaaagatgggccacgacatcgactttctgatcacgaatccgggcccgggtgaggatgacgaactgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgcctcagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 828 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIFRLEFLRAASLLKYLPFPVTRMKDIQGLPCIGDQVRDVIEEILEYGESSRVKEVLNDERYKAFKQFTSVFGVGVKTSEKWFRMGLRTVEELKASKSLKLSKMQKAGFLYYEDLASCVSKAEADAVTLIVKNTVRTFLPGALVTLTGGFRRGKKMGHDIDFLITNPGPGEDDELLHKVVDGLKKQGLLLYCDIIESTFVEEQLPSRKIDAMDNFQKCFAILKLPQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 829 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaacgcagagtttaacgggaacgaaatcttctgtctggaatttctgcgcgccgcgagtctgctgaaatatctgccgttcccggttacccgcatgaaagacattcaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 830 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENAEFNGNEIFCLEFLRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 831 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactatgagtttaacgagaacgaaatcttctgtctggaatttctgcgcgccgcgagtctgctgaaatatctgccgttcccggttacccgcatgaaagacctgcaaggtctgccgtgcattggcgaccaagttcgtgacgtgatcgaggagatcatcgaatatggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgaactgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgcctcagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 832 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFNENEIFCLEFLRAASLLKYLPFPVTRMKDLQGLPCIGDQVRDVIEEIIEYGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLPQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 833 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacctgcaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggacgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 834 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIFRLEFLRAASLLKYLPFPVTRMKDLQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 835 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaacgcagagtttaacgggaacgaaatcttctgtctggaatttctgcgcgccgcgagtctgctgaaatatctgccgttcccggttacccgcatgaaagacattcaaggtctgccgtgcattggcgaccaagttcgtcgcgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgggtgaggatgacgaactgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 836 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENAEFNGNEIFCLEFLRAASLLKYLPFPVTRMKDIQGLPCIGDQVRRVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPGEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 837 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacctgcaaggtctgccgtgcattggcgaccaagttcgtgacgtgatcgaggagatcctggaagaaggcgagagcagccgtgttaaagaagttctcaatgacgagcgctacaaggcctttaagcagttcaccagcgtgttcggtgtgggcgtgaaaaccagcgaaaagtggtatcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccgggcgcgctggtgaccctgacgggcggtttccgccgtggcaaaaagatgggccacgacatcgactttctgatcacgaatccgggcccgggtgaggatgacgaactgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 838 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIFRLEFLRAASLLKYLPFPVTRMKDLQGLPCIGDQVRDVIEEILEEGESSRVKEVLNDERYKAFKQFTSVFGVGVKTSEKWYRMGLRTVEELKASKSLKLSKMQKAGFLYYEDLASCVSKAEADAVTLIVKNTVRTFLPGALVTLTGGFRRGKKMGHDIDFLITNPGPGEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 839 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaacgcagagtttaacgggaacgaaatcttctgtctggaatttctgcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtatcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgaactgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 840 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENAEFNGNEIFCLEFLRAASLLKYLPFPVTRMKDIQGLPCIGDQVRDVIEEIIEEGESSRVKEVLNDERYKAFKQFTSVFGVGVKTSEKWYRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 841 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactatgagtttaacgagaacgaaatcttctgtctggaatttctgcgcgccgcgagtctgctgaaatatctgccgttcccggttacccgcatgaaagacattcaaggtctgccgtgcattggcgaccaagttcgtcgcgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgaactgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 842 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFNENEIFCLEFLRAASLLKYLPFPVTRMKDIQGLPCIGDQVRRVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 843 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcttccgtctggaatttctgcgcgccgcgagtctgctgaaatatctgccgttcccggttacccgcatgaaagacctgcaaggtctgccgtgcattggcgaccaagttcgtgacgtgatcgaggagatcctggaatatggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 844 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIFRLEFLRAASLLKYLPFPVTRMKDLQGLPCIGDQVRDVIEEILEYGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAIRVDLVITPFEQYAYALLGWTGSREFGRDLRRYASHERKMILDNHGLYDRKKRIFLKAGSEEEIFAHLGLDYVEPWERNA

SEQ ID NO: 845 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgtttgagatcctggccgagaactacgaatttaaagagaacgaaatcgctcgtctggaatttctgcgcgccgcgagtctgctgaaatatctgccgttcccggttaccagtatgaaagacatccaaggtctgccgtgcattggccctcaagttcgtgacgtgatcgaggagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtacggtgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtgttgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 846 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEILAENYEFKENEIARLEFLRAASLLKYLPFPVTSMKDIQGLPCIGPQVRDVIEEIIETGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYGDIIESTFVEEQLPSRKIDAMDNFQKCFAILKLYQPGVDNSSYNTSKKSDMAEVKDWKAVRVDLVITPFEQYAYALLGWTGSREFGRDLRRYASVERKMILDNHGLYDRKKRIFLKAGSEEEIFAHLGLDYVEPWERNA

SEQ ID NO: 847 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgtttgagatcctggccgagaactacgaatttaaagagaacgaaatcgctcgtctggaatttctgcgcgccgcgagtctgctgaaatatctgccgttcccggttaccagtatgaaagacatccaaggtctgccgtgcattggcgaccaagttcgtgatgtgatcgaggagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcccgctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaacaggatgacgagctgctccacaaagtggttgatgggctcaagaagcaaggtctgctgctgtacgaagacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtgttgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 848 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEILAENYEFKENEIARLEFLRAASLLKYLPFPVTSMKDIQGLPCIGDQVRDVIEEIIETGESSRVKEVLNDERYKAFKQFTSVFGVGVKTSEKWFRMGLRTVEEAKASKSLKLSKMQKAGFLYYEDLARCVSKAEADAVTLIVKNTVRTFLPDALVTITGGFRRGKKMGHDIDFLITNPGPKQDDELLHKVVDGLKKQGLLLYEDIIESTFVEEQLPSRKIDAMDNFQKCFAILKLYQPGVDNSSYNTSKKSDMAEVKDWKAVRVDLVITPFEQYAYALLGWTGSREFGRDLRRYASVERKMILDNHGLYDRKKRIFLKAGSEEEIFAHLGLDYVEPWERNA

SEQ ID NO: 849 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgctggagatcatggccgagaactacgaatttaaagagaacgaaatcgctcgtctggaatttctgcgcgccgcgagtctgctgaaatatctgccgttcccggttaccagtatgaaagacatccaaggtctgccgtgcattggccctcaagttcgtgacgtgatcgaggagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcccgctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaacaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 850 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDALEIMAENYEFKENEIARLEFLRAASLLKYLPFPVTSMKDIQGLPCIGPQVRDVIEEIIETGESSRVKEVLNDERYKAFKQFTSVFGVGVKTSEKWFRMGLRTVEEAKASKSLKLSKMQKAGFLYYEDLARCVSKAEADAVTLIVKNTVRTFLPDALVTITGGFRRGKKMGHDIDFLITNPGPKQDDELLHKVVDGLKKQGLLLYCDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 851 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgtttgagatcatggccgagaactacgaatttaaagagaacgaaatcgctcgtctggaatttctgcgcgccgcgagtctgctgaaatatctgccgttcccggttaccagtatgaaagacatccaaggtctgccgtgcattggcgaccaagttcgtgatgtgatcgaggagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaacaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 852 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIARLEFLRAASLLKYLPFPVTSMKDIQGLPCIGDQVRDVIEEIIETGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKQDDELLHKVVDGLKKQGLLLYCDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 853 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgctggagatcatggccgagaactacgaatttaaagagaacgaaatcgctcgtctggaatttctgcgcgccgcgagtctgctgaaatatctgccgttcccggttaccagtatgaaagacatccaaggtctgccgtgcattggcgaccaagttcgtgatgtgatccgtgagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtacgaagacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 854 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDALEIMAENYEFKENEIARLEFLRAASLLKYLPFPVTSMKDIQGLPCIGDQVRDVIREIIETGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYEDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 855 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgctggagatcatggccgagaactacgaatttaaagagaacgaaatcgctcgtctggaatttctgcgcgccgcgagtctgctgaaatatctgccgttcccggttaccagtatgaaagacatccaaggtctgccgtgcattggcgaccaagttcgtgatgtgatccgtgagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggcccgctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaacaggatgacgagctgctccacaaagtggttgatgggctcaagaagcaaggtctgctgctgtacggtgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 856 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDALEIMAENYEFKENEIARLEFLRAASLLKYLPFPVTSMKDIQGLPCIGDQVRDVIREIIETGESSRVKEVLNDERYKAFKQFTSVFGVGVKTSEKWFRMGLRTVEEAKASKSLKLSKMQKAGFLYYEDLARCVSKAEADAVTLIVKNTVRTFLPDALVTITGGFRRGKKMGHDIDFLITNPGPKQDDELLHKVVDGLKKQGLLLYGDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 857 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcgctcgtctggaatttctgcgcgccgcgagtctgctgaaatatctgccgttcccggttaccagtatgaaagacatccaaggtctgccgtgcattggcgaccaagttcgtgacgtgatcgaggagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcctgctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 858 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIARLEFLRAASLLKYLPFPVTSMKDIQGLPCIGDQVRDVIEEIIETGESSRVKEVLNDERYKAFKQFTSVFGVGVKTSEKWFRMGLRTVEEAKASKSLKLSKMQKAGLLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 859 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgctggagatcctggccgagaactacgaatttaaagagaacgaaatcgctcgtctggaatttctgcgcgccgcgagtctgctgaaatatctgccgttcccggttaccagtatgaaagacatccaaggtctgccgtgcattggcgaccaagttcgtgatgtgatccgtgagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtacggtgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 860 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDALEILAENYEFKENEIARLEFLRAASLLKYLPFPVTSMKDIQGLPCIGDQVRDVIREIIETGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYGDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 861 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgctggagatcatggccgagaactacgaatttaaagagaacgaaatcgctcgtctggaatttctgcgcgccgcgagtctgctgaaatatctgccgttcccggttaccagtatgaaagacatccaaggtctgccgtgcattggcgaccaagttcgtgatgtgatcgaggagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcctgctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaacaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 862 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDALEIMAENYEFKENEIARLEFLRAASLLKYLPFPVTSMKDIQGLPCIGDQVRDVIEEIIETGESSRVKEVLNDERYKAFKQFTSVFGVGVKTSEKWFRMGLRTVEEAKASKSLKLSKMQKAGLLYYEDLASCVSKAEADAVTLIVKNTVRTFLPDALVTITGGFRRGKKMGHDIDFLITNPGPKQDDELLHKVVDGLKKQGLLLYCDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 863 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgctggagatcctggccgagaactacgaatttaaagagaacgaaatcgctcgtctggaatttctgcgcgccgcgagtctgctgaaatatctgccgttcccggttaccagtatgaaagacatccaaggtctgccgtgcattggcgatcaagttcgtgacgtgatcgaggagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggcccgctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtacggtgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 864 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDALEILAENYEFKENEIARLEFLRAASLLKYLPFPVTSMKDIQGLPCIGDQVRDVIEEIIETGESSRVKEVLNDERYKAFKQFTSVFGVGVKTSEKWFRMGLRTVEEAKASKSLKLSKMQKAGFLYYEDLARCVSKAEADAVTLIVKNTVRTFLPDALVTITGGFRRGKKMGHDIDFLITNPGPKEDDELLHKVVDGLKKQGLLLYGDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 865 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgctggagatcatggccgagaactacgaatttaaagagaacgaaatcgctcgtctggaatttctgcgcgccgcgagtctgctgaaatatctgccgttcccggttaccagtatgaaagacatccaaggtctgccgtgcattggcgatcaagttcgtgacgtgatcgaggagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaacaggatgacgagctgctccacaaagtggttgatgggctcaagaagcaaggtctgctgctgtactgtgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 866 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDALEIMAENYEFKENEIARLEFLRAASLLKYLPFPVTSMKDIQGLPCIGDQVRDVIEEIIETGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKQDDELLHKVVDGLKKQGLLLYCDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 867 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacgaatttaaagagaacgaaatcgctcgtctggaatttctgcgcgccgcgagtctgctgaaatatctgccgttcccggttaccagtatgaaagacatccaaggtctgccgtgcattggccctcaagttcgtgacgtgatcgaggagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaacaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 868 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIARLEFLRAASLLKYLPFPVTSMKDIQGLPCIGPQVRDVIEEIIETGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKQDDELLHKVVDGLKKQGLLLYCDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 869 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgtttgagatcctggccgagaactacgaatttaaagagaacgaaattgcccgtctggaatttctgcgcgccgcgagtctgctgaaatatctgccgttcccggttaccagtatgaaagacatccaaggtctgccgtgcattggccctcaagttcgtgacgtgatcgaggagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcccgctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtacggtgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 870 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEILAENYEFKENEIARLEFLRAASLLKYLPFPVTSMKDIQGLPCIGPQVRDVIEEIIETGESSRVKEVLNDERYKAFKQFTSVFGVGVKTSEKWFRMGLRTVEEAKASKSLKLSKMQKAGFLYYEDLARCVSKAEADAVTLIVKNTVRTFLPDALVTITGGFRRGKKMGHDIDFLITNPGPKEDDELLHKVVDGLKKQGLLLYGDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 871 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgctggagatcatggccgagaactacgaatttaaagagaacgaaatcgctcgtctggaatttctgcgcgccgcgagtctgctgaaatatctgccgttcccggttaccagtatgaaagacatccaaggtctgccgtgcattggcgaccaagttcgtgatgtgatcgaggagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaacaggatgacgagctgctccacaaagtggttgatgggctcaagaagcaaggtctgctgctgtacgaagacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 872 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDALEIMAENYEFKENEIARLEFLRAASLLKYLPFPVTSMKDIQGLPCIGDQVRDVIEEIIETGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKQDDELLHKVVDGLKKQGLLLYEDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 873 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgctggagatcctggccgagaactacgaatttaaagagaacgaaatcgctcgtctggaatttctgcgcgccgcgagtctgctgaaatatctgccgttcccggttaccagtatgaaagacatccaaggtctgccgtgcattggcgatcaagttcgtgacgtgatcgaggagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggcccgctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaacaggatgacgagctgctccacaaagtggttgatgggctcaagaagcaaggtctgctgctgtacgaagacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 874 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDALEILAENYEFKENEIARLEFLRAASLLKYLPFPVTSMKDIQGLPCIGDQVRDVIEEIIETGESSRVKEVLNDERYKAFKQFTSVFGVGVKTSEKWFRMGLRTVEEAKASKSLKLSKMQKAGFLYYEDLARCVSKAEADAVTLIVKNTVRTFLPDALVTITGGFRRGKKMGHDIDFLITNPGPKQDDELLHKVVDGLKKQGLLLYEDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 875 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgtttgagatcatggccgagaactacgaatttaaagagaacgaaatcgctcgtctggaatttctgcgcgccgcgagtctgctgaaatatctgccgttcccggttaccagtatgaaagacatccaaggtctgccgtgcattggcgaccaagttcgtgatgtgatccgtgagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 876 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYEFKENEIARLEFLRAASLLKYLPFPVTSMKDIQGLPCIGDQVRDVIREIIETGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 877 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgctggagatcatggccgagaactacgaatttaaagagaacgaaatcgctcgtctggaatttctgcgcgccgcgagtctgctgaaatatctgccgttcccggttaccagtatgaaagacatccaaggtctgccgtgcattggcgaccaagttcgtgatgtgatccgtgagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaacaggatgacgagctgctccacaaagtggttgatgggctcaagaagcaaggtctgctgctgtacggtgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 878 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDALEIMAENYEFKENEIARLEFLRAASLLKYLPFPVTSMKDIQGLPCIGDQVRDVIREIIETGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKQDDELLHKVVDGLKKQGLLLYGDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 879 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgtttgagatcctggccgagaactacgaatttaaagagaacgaaatcgctcgtctggaatttctgcgcgccgcgagtctgctgaaatatctgccgttcccggttaccagtatgaaagacatccaaggtctgccgtgcattggcgaccaagttcgtgatgtgatcgaggagatcatcgaaaccggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtacggtgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagccgcgaatttggtcgcgatctgcgccgctatgcgagtcatgagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 880 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEILAENYEFKENEIARLEFLRAASLLKYLPFPVTSMKDIQGLPCIGDQVRDVIEEIIETGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYGDIIESTFVEEQLPSRKIDAMDNFQKCFAILKLYQPGVDNSSYNTSKKSDMAEVKDWKAVRVDLVITPFEQYAYALLGWTGSREFGRDLRRYASHERKMILDNHGLYDRKKRIFLKAGSEEEIFAHLGLDYVEPWERNA

SEQ ID NO: 881 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttctgtctggaatttaagcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 882 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIFCLEFKRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 883 - DNA, 1182 bp, synthetic construct; identical to SEQ ID NO: 691
  misc_feature 1..1182: note = Variant of terminal deoxynucleotidyl transferase
  source 1..1182: mol_type = other DNA

SEQ ID NO: 884 - protein, 394 aa, synthetic construct; identical to SEQ ID NO: 692
  REGION 1..394: note = Variant of terminal deoxynucleotidyl transferase

SEQ ID NO: 885 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttctgtctggaatttaagcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcggagcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 886 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIFCLEFKRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEHERKMILDRHGLYDRKKRIFLKAGSEEEIFAHLGLDYVEPWERNA

SEQ ID NO: 887 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttctgtctggaatttaagcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatctgtggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 888 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIFCLEFKRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTICGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 889 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacaaatttaaaggtaacgaaatcttctgtctggaatttaagcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 890 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKGNEIFCLEFKRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 891 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttctgtctggaatttcggcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 892 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIFCLEFRRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 893 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttctgtctggaatttaagcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgatgcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 894 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIFCLEFKRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAMHERKMILDRHGLYDRKKRIFLKAGSEEEIFAHLGLDYVEPWERNA

SEQ ID NO: 895 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttctgtctggaatttaagcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagttatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 896 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIFCLEFKRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASYERKMILDRHGLYDRKKRIFLKAGSEEEIFAHLGLDYVEPWERNA

SEQ ID NO: 897 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttctgtctggaatttaagcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgaccggatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 898 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIFCLEFKRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDRMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 899 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttcatgctggaatttaagcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 900 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIFMLEFKRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 901 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttctgtctggaatttaagcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgcggcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 902 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIFCLEFKRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYARHERKMILDRHGLYDRKKRIFLKAGSEEEIFAHLGLDYVEPWERNA

SEQ ID NO: 903 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttctgtctggaatttaagcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtgaggagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 904 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIFCLEFKRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASEERKMILDRHGLYDRKKRIFLKAGSEEEIFAHLGLDYVEPWERNA

SEQ ID NO: 905 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttctgtctggaatttaagcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagcggggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 906 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIFCLEFKRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKRGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 907 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcgcgtgtctggaatttaagcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggtgagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatggtctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 908 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDAFEIMAENYKFKENEIACLEFKRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLVSCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAVRVDLVITPFEQYAYALLGWTGSKEFGRDLRRYASHERKMILDRHGLYDRKKRIFLKAGSEEEIFAHLGLDYVEPWERNA

SEQ ID NO: 909 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttctgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatggtctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 910 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIFCLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 911 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggaggggggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttttgtctggaatttaagcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggcgagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatggtctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 912 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIFCLEFKRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAVRVDLVITPFEQYAYALLGWTGSKEFGRDLRRYASHERKMILDRHGLYDRKKRIFLKAGSEEEIFAHLGLDYVEPWERNA

SEQ ID NO: 913 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggcgagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 914 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDAFEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 915 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggaggggggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttttgtctggaatttaagcgcgccgcgagtctgctgaaatatctgccgttcccggttaccagcatgaaagacatccaaggtctgccgtgcattggcgaccaagttcgtgacgtgatcgaggagatcatcgaaactggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 916 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIFCLEFKRAASLLKYLPFPVTSMKDIQGLPCIGDQVRDVIEEIIETGESSRVKEVLNDERYKAFKQFTSVFGVGVKTSEKWFRMGLRTVEELKASKSLKLSKMQKAGFLYYEDLASCVSKAEADAVTLIVKNTVSTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 917 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggaggggggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcgcgtgtctggaatttaagcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 918 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIACLEFKRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLVSCVSKAEADAVTLIVKNTVSTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAVRVDLVITPFEQYAYALLGWTGSKEFGRDLRRYASHERKMILDRHGLYDRKKRIFLKAGSEEEIFAHLGLDYVEPWERNA

SEQ ID NO: 919 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggaggggggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 920 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 921 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggaggggggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcgcgtgtctggaatttaagcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccgacaagagtctgaagctgagcaagatgcagaaggcgggctttctgtattacgaggatctggtgagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatggtctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 922 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIACLEFKRAASLLKYLPFPVTRMKDIQGLPCIGDQVRDVIEEIIEEGESSRVKEVLNDERYKAFKQFTSVFGVGVKTSEKWFRMGLRTVEEAKADKSLKLSKMQKAGFLYYEDLVSCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 923 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcgcgtgtctggaatttaagcgcgccgcgagtctgctgaaatatctgccgttcccggttacccgcatgaaagacatccaaggtctgccgtgcattggcgaccaagttcgtgacgtgatcgaggagatcatcgaaactggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggcgagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 924 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIACLEFKRAASLLKYLPFPVTRMKDIQGLPCIGDQVRDVIEEIIETGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 925 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttctgtctggaatttaagcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggcgagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatggtctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 926 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDAFEIMAENYKFKENEIFCLEFKRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAVRVDLVITPFEQYAYALLGWTGSKEFGRDLRRYASHERKMILDRHGLYDRKKRIFLKAGSEEEIFAHLGLDYVEPWERNA

SEQ ID NO: 927 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttctgtctggaatttaagcgcgccgcgagtctgctgaaatatctgccgttcccggttaccagcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggcgagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 928 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDAFEIMAENYKFKENEIFCLEFKRAASLLKYLPFPVTSMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAVRVDLVITPFEQYAYALLGWTGSKEFGRDLRRYASHERKMILDRHGLYDRKKRIFLKAGSEEEIFAHLGLDYVEPWERNA

SEQ ID NO: 929 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttctgtctggaatttaagcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggcgagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 930 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDAFEIMAENYKFKENEIFCLEFKRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 931 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttctgtctggaatttaagcgcgccgcgagtctgctgaaatatctgccgttcccggttaccagcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggtgagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 932 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYKFKENEIFCLEFKRAASLLKYLPFPVTSMKDIQGLPCIGDQVRDVIEEIIEEGESSRVKEVLNDERYKAFKQFTSVFGVGVKTSEKWFRMGLRTVEELKASKSLKLSKMQKAGFLYYEDLVSCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAVRVDLVITPFEQYAYALLGWTGSKEFGRDLRRYASHERKMILDRHGLYDRKKRIFLKAGSEEEIFAHLGLDYVEPWERNA

SEQ ID NO: 933 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcgcgtgtctggaatttaagcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatggtctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 934 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYKFKENEIACLEFKRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 935 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttctgtctggaatttaagcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccgacaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 936 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIFCLEFKRAASLLKYLPFPVTRMKDIQGLPCIGDQVRDVIEEIIEEGESSRVKEVLNDERYKAFKQFTSVFGVGVKTSEKWFRMGLRTVEEAKADKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 937 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggaggggggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttttgtctggaatttaagcgcgccgcgagtctgctgaaatatctgccgttcccggttaccagcatgaaagacatccaaggtctgccgtgcattggcgaccaagttcgtgacgtgatcgaggagatcatcgaaactggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 938 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIFCLEFKRAASLLKYLPFPVTSMKDIQGLPCIGDQVRDVIEEIIETGESSRVKEVLNDERYKAFKQFTSVFGVGVKTSEKWFRMGLRTVEELKASKSLKLSKMQKAGFLYYEDLASCVSKAEADAVTLIVKNTVSTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 939 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggaggggggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaaactggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccgacaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatggtctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 940 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIACLEFKRAASLLKYLPFPVTSMKDIQGLPCIGDQVRDVIEEIIETGESSRVKEVLNDERYKAFKQFTSVFGVGVKTSEKWFRMGLRTVEEAKADKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAVRVDLVITPFEQYAYALLGWTGSKEFGRDLRRYASHERKMILDRHGLYDRKKRIFLKAGSEEEIFAHLGLDYVEPWERNA

SEQ ID NO: 941 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttctgtctggaatttaagcgcgccgcgagtctgctgaaatatctgccgttcccggttacccgcatgaaagacatccaaggtctgccgtgcattggcgaccaagttcgtgacgtgatcgaggagatcatcgaaactggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 942 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYKFKENEIFCLEFKRAASLLKYLPFPVTRMKDIQGLPCIGDQVRDVIEEIIETGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 943 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttttgtctggaatttaagcgcgccgcgagtctgctgaaatatctgccgttcccggttaccagcatgaaagacatccaaggtctgccgtgcattggcgaccaagttcgtgacgtgatcgaggagatcatcgaaactggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggcgagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 944 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYKFKENEIFCLEFKRAASLLKYLPFPVTSMKDIQGLPCIGDQVRDVIEEIIETGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAVRVDLVITPFEQYAYALLGWTGSKEFGRDLRRYASHERKMILDRHGLYDRKKRIFLKAGSEEEIFAHLGLDYVEPWERNA

SEQ ID NO: 945 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaaactggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 946 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYKFKENEIACLEFKRAASLLKYLPFPVTSMKDIQGLPCIGDQVRDVIEEIIETGESSRVKEVLNDERYKAFKQFTSVFGVGVKTSEKWFRMGLRTVEELKASKSLKLSKMQKAGFLYYEDLASCVSKAEADAVTLIVKNTVSTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 947 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttttgtctggaatttaagcgcgccgcgagtctgctgaaatatctgccgttcccggttaccagcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggcgagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 948 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDAFEIMAENYKFKENEIFCLEFKRAASLLKYLPFPVTSMKDIQGLPCIGDQVRDVIEEIIEEGESSRVKEVLNDERYKAFKQFTSVFGVGVKTSEKWFRMGLRTVEELKADKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAVRVDLVITPFEQYAYALLGWTGSKEFGRDLRRYASHERKMILDRHGLYDRKKRIFLKAGSEEEIFAHLGLDYVEPWERNA

SEQ ID NO: 949 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggaggggggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcgcgtgtctggaatttaagcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgagctgctccacaaagtggttgatggtctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 950 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIACLEFKRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLVSCVSKAEADAVTLIVKNTVSTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 951 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttttgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccgacaagagtctgaagctgagcaagatgcagaaggcgggctttctgtattacgaggatctggcgagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 952 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDAFEIMAENYKFKENEIFCLEFKRAASLLKYLPFPVTSMKDIQGLPCIGDQVRDVIEEIIEEGESSRVKEVLNDERYKAFKQFTSVFGVGVKTSEKWFRMGLRTVEEAKADKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 953 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttctgtctggaatttaagcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 954 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIFCLEFKRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 955 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctgggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttctgtctggaatttaagcgcgccgcgagtctgctgaaatatctgccgttcccggttaccagcatgaaagacatccaaggtctgccgtgcattggcgaccaagttcgtgacgtgatcgaggagatcatcgaaactggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggtgagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatggtctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 956 - protein, 394 aa, synthetic construct
  REGION 1..394: note = Variant of terminal deoxynucleotidyl transferase
MHHHHHHGGSGHPPSNTPELGVPSVIARKVSQYSCQRKTTLNNYNKKFTDAFEIMAENYKFKENEIFCLEFKRAASLLKYLPFPVTSMKDIQGLPCIGDQVRDVIEEIIETGESSRVKEVLNDERYKAFKQFTSVFGVGVKTSEKWFRMGLRTVEELKASKSLKLSKMQKAGFLYYEDLVSCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 957 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttttgtctggaatttaagcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggcgagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 958 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIFCLEFKRAASLLKYLPFPVTRMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 959 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggaggggggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttttgtctggaatttaagcgcgccgcgagtctgctgaaatatctgccgttcccggttaccagcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgagctgctccacaaagtggttgatggtctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 960 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIFCLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLVSCVSKAEADAVTLIVKNTVSTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 961 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttttgtctggaatttaagcgcgccgcgagtctgctgaaatatctgccgttcccggttacccgcatgaaagacatccaaggtctgccgtgcattggcgaccaagttcgtgacgtgatcgaggagatcatcgaaactggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 962 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDAFEIMAENYKFKENEIFCLEFKRAASLLKYLPFPVTRMKDIQGLPCIGDQVRDVIEEIIETGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 963 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcgcgtgtctggaatttaagcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccgacaagagtctgaagctgagcaagatgcagaaggcgggctttctgtattacgaggatctggcgagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 964 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIACLEFKRAASLLKYLPFPVTRMKDIQGLPCIGDQVRDVIEEIIEEGESSRVKEVLNDERYKAFKQFTSVFGVGVKTSEKWFRMGLRTVEEAKADKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAVRVDLVITPFEQYAYALLGWTGSKEFGRDLRRYASHERKMILDRHGLYDRKKRIFLKAGSEEEIFAHLGLDYVEPWERNA

SEQ ID NO: 965 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctgggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttttgtctggaatttaagcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggcgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 966 - protein, 394 aa, synthetic construct
  REGION 1..394: note = Variant of terminal deoxynucleotidyl transferase
MHHHHHHGGSGHPPSNTPELGVPSVIARKVSQYSCQRKTTLNNYNKKFTDAFEIMAENYKFKENEIFCLEFKRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVSTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 967 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttctgtctggaatttaagcgcgccgcgagtctgctgaaatatctgccgttcccggttacccgcatgaaagacatccaaggtctgccgtgcattggcgaccaagttcgtgacgtgatcgaggagatcatcgaaactggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggtgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgagctgctccacaaagtggttgatggtctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 968 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIFCLEFKRAASLLKYLPFPVTRMKDIQGLPCIGDQVRDVIEEIIETGESSRVKEVLNDERYKAFKQFTSVFGVGVKTSEKWFRMGLRTVEEAKASKSLKLSKMQKAGFLYYEDLVSCVSKAEADAVTLIVKNTVSTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAVRVDLVITPFEQYAYALLGWTGSKEFGRDLRRYASHERKMILDRHGLYDRKKRIFLKAGSEEEIFAHLGLDYVEPWERNA

SEQ ID NO: 969 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttctgtctggaatttaagcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 970 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDAFEIMAENYKFKENEIFCLEFKRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVSTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAVRVDLVITPFEQYAYALLGWTGSKEFGRDLRRYASHERKMILDRHGLYDRKKRIFLKAGSEEEIFAHLGLDYVEPWERNA

SEQ ID NO: 971 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggtgagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 972 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLVSCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 973 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcgcgtgtctggaatttaagcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 974 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIACLEFKRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 975 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctgggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccgacaagagtctgaagctgagcaagatgcagaaggcgggctttctgtattacgaggatctggtgagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatggtctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 976 - protein, 394 aa, synthetic construct
  REGION 1..394: note = Variant of terminal deoxynucleotidyl transferase
MHHHHHHGGSGHPPSNTPELGVPSVIARKVSQYSCQRKTTLNNYNKKFTDAFEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKADKSLKLSKMQKAGFLYYEDLVSCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAVRVDLVITPFEQYAYALLGWTGSKEFGRDLRRYASHERKMILDRHGLYDRKKRIFLKAGSEEEIFAHLGLDYVEPWERNA

SEQ ID NO: 977 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaaactggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggcgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 978 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDAFEIMAENYKFKENEIACLEFKRAASLLKYLPFPVTSMKDIQGLPCIGDQVRDVIEEIIETGESSRVKEVLNDERYKAFKQFTSVFGVGVKTSEKWFRMGLRTVEELKASKSLKLSKMQKAGFLYYEDLASCVSKAEADAVTLIVKNTVSTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 979 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctgggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatctttcgtctggaatttaagcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggccagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 980 - protein, 394 aa, synthetic construct
  REGION 1..394: note = Variant of terminal deoxynucleotidyl transferase
MHHHHHHGGSGHPPSNTPELGVPSVIARKVSQYSCQRKTTLNNYNKKFTDAFEIMAENYKFKENEIFRLEFKRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLASCVSKAEADAVTLIVKNTVSTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 981 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttctgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggcgagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatggtctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 982 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYKFKENEIFCLEFKRAASLLKYLPFPVTSMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAVRVDLVITPFEQYAYALLGWTGSKEFGRDLRRYASHERKMILDRHGLYDRKKRIFLKAGSEEEIFAHLGLDYVEPWERNA

SEQ ID NO: 983 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctgggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatctttcgtctggaatttaagcgcgccgcgagtctgctgaaatatctgccgttcccggttacccgcatgaaagacatccaaggtctgccgtgcattggcgaccaagttcgtgacgtgatcgaggagatcatcgaaactggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccgacaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 984 - protein, 394 aa, synthetic construct
  REGION 1..394: note = Variant of terminal deoxynucleotidyl transferase
MHHHHHHGGSGHPPSNTPELGVPSVIARKVSQYSCQRKTTLNNYNKKFTDAFEIMAENYKFKENEIFRLEFKRAASLLKYLPFPVTRMKDIQGLPCIGDQVRDVIEEIIETGESSRVKEVLNDERYKAFKQFTSVFGVGVKTSEKWFRMGLRTVEEAKADKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 985 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttctgtctggaatttaagcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggcgagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatggtctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 986 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYKFKENEIFCLEFKRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAVRVDLVITPFEQYAYALLGWTGSKEFGRDLRRYASHERKMILDRHGLYDRKKRIFLKAGSEEEIFAHLGLDYVEPWERNA

SEQ ID NO: 987 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttctgtctggaatttaagcgcgccgcgagtctgctgaaatatctgccgttcccggttacccgcatgaaagacatccaaggtctgccgtgcattggcgaccaagttcgtgacgtgatcgaggagatcatcgaaactggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatggtctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 988 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYKFKENEIFCLEFKRAASLLKYLPFPVTRMKDIQGLPCIGDQVRDVIEEIIETGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAVRVDLVITPFEQYAYALLGWTGSKEFGRDLRRYASHERKMILDRHGLYDRKKRIFLKAGSEEEIFAHLGLDYVEPWERNA

SEQ ID NO: 989 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttctgtctggaatttaagcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggcgagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 990 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDAFEIMAENYKFKENEIFCLEFKRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 991 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctgggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaaactggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggtgagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 992 - protein, 394 aa, synthetic construct
  REGION 1..394: note = Variant of terminal deoxynucleotidyl transferase
MHHHHHHGGSGHPPSNTPELGVPSVIARKVSQYSCQRKTTLNNYNKKFTDAFEIMAENYKFKENEIACLEFKRAASLLKYLPFPVTSMKDIQGLPCIGDQVRDVIEEIIETGESSRVKEVLNDERYKAFKQFTSVFGVGVKTSEKWFRMGLRTVEELKASKSLKLSKMQKAGFLYYEDLVSCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 993 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttttgtctggaatttaagcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 994 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYKFKENEIFCLEFKRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 995 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcgcgtgtctggaatttaagcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatggtctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 996 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIACLEFKRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAVRVDLVITPFEQYAYALLGWTGSKEFGRDLRRYASHERKMILDRHGLYDRKKRIFLKAGSEEEIFAHLGLDYVEPWERNA

SEQ ID NO: 997 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaaactggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 998 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYKFKENEIACLEFKRAASLLKYLPFPVTSMKDIQGLPCIGDQVRDVIEEIIETGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAVRVDLVITPFEQYAYALLGWTGSKEFGRDLRRYASHERKMILDRHGLYDRKKRIFLKAGSEEEIFAHLGLDYVEPWERNA

SEQ ID NO: 999 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttctgtctggaatttaagcgcgccgcgagtctgctgaaatatctgccgttcccggttaccagcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggcgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgagctgctccacaaagtggttgatggtctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1000 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDAFEIMAENYKFKENEIFCLEFKRAASLLKYLPFPVTSMKDIQGLPCIGDQVRDVIEEIIEEGESSRVKEVLNDERYKAFKQFTSVFGVGVKTSEKWFRMGLRTVEELKADKSLKLSKMQKAGFLYYEDLASCVSKAEADAVTLIVKNTVSTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAVRVDLVITPFEQYAYALLGWTGSKEFGRDLRRYASHERKMILDRHGLYDRKKRIFLKAGSEEEIFAHLGLDYVEPWERNA

SEQ ID NO: 1001 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatctttcgtctggaatttaagcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccgacaagagtctgaagctgagcaagatgcagaaggcgggctttctgtattacgaggatctggccagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgagctgctccacaaagtggttgatggtctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1002 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIFRLEFKRAASLLKYLPFPVTRMKDIQGLPCIGDQVRDVIEEIIEEGESSRVKEVLNDERYKAFKQFTSVFGVGVKTSEKWFRMGLRTVEEAKADKSLKLSKMQKAGFLYYEDLASCVSKAEADAVTLIVKNTVSTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAVRVDLVITPFEQYAYALLGWTGSKEFGRDLRRYASHERKMILDRHGLYDRKKRIFLKAGSEEEIFAHLGLDYVEPWERNA

SEQ ID NO: 1003 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcgcgtgtctggaatttaagcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1004 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYKFKENEIACLEFKRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 1005 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggcgagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1006 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 1007 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttttgtctggaatttaagcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccgacaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1008 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDAFEIMAENYKFKENEIFCLEFKRAASLLKYLPFPVTRMKDIQGLPCIGDQVRDVIEEIIEEGESSRVKEVLNDERYKAFKQFTSVFGVGVKTSEKWFRMGLRTVEEAKADKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 1009 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggaggggggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttctgtctggaatttaagcgcgccgcgagtctgctgaaatatctgccgttcccggttaccagcatgaaagacatccaaggtctgccgtgcattggcgaccaagttcgtgacgtgatcgaggagatcatcgaaactggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatggtctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1010 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIFCLEFKRAASLLKYLPFPVTSMKDIQGLPCIGDQVRDVIEEIIETGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 1011 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaaactggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1012 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYKFKENEIACLEFKRAASLLKYLPFPVTSMKDIQGLPCIGDQVRDVIEEIIETGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 1013 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctgggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttttgtctggaatttaagcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccgacaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1014 - protein, 394 aa, synthetic construct
  REGION 1..394: note = Variant of terminal deoxynucleotidyl transferase
MHHHHHHGGSGHPPSNTPELGVPSVIARKVSQYSCQRKTTLNNYNKKFTDAFEIMAENYKFKENEIFCLEFKRAASLLKYLPFPVTRMKDIQGLPCIGDQVRDVIEEIIEEGESSRVKEVLNDERYKAFKQFTSVFGVGVKTSEKWFRMGLRTVEELKADKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAVRVDLVITPFEQYAYALLGWTGSKEFGRDLRRYASHERKMILDRHGLYDRKKRIFLKAGSEEEIFAHLGLDYVEPWERNA

SEQ ID NO: 1015 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggaggggggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatctttcgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggcgagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1016 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIFRLEFKRAASLLKYLPFPVTSMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 1017 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggcgagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1018 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAVRVDLVITPFEQYAYALLGWTGSKEFGRDLRRYASHERKMILDRHGLYDRKKRIFLKAGSEEEIFAHLGLDYVEPWERNA

SEQ ID NO: 1019 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttctgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggcgagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgagctgctccacaaagtggttgatggtctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1020 - protein, 394 aa, synthetic construct
  REGION 1..394: note = Variant of terminal deoxynucleotidyl transferase
MHHHHHHGGSGHPPSNTPELEVPSVIARKVSQYSCQRKTTLNNYNKKFTDAFEIMAENYKFKENEIFCLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVSTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 1021 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcgcgtgtctggaatttaagcgcgccgcgagtctgctgaaatatctgccgttcccggttacccgcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1022 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDAFEIMAENYKFKENEIACLEFKRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVSTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 1023 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttctgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1024 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDAFEIMAENYKFKENEIFCLEFKRAASLLKYLPFPVTSMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVSTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 1025 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcgcgtgtctggaatttaagcgcgccgcgagtctgctgaaatatctgccgttcccggttacccgcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1026 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIACLEFKRAASLLKYLPFPVTRMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 1027 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagctgggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttctgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccgacaagagtctgaagctgagcaagatgcagaaggcgggctttctgtattacgaggatctggcgagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1028 - protein, 394 aa, synthetic construct
  REGION 1..394: note = Variant of terminal deoxynucleotidyl transferase
MHHHHHHGGSGHPPSNTPELGVPSVIARKVSQYSCQRKTTLNNYNKKFTDAFEIMAENYKFKENEIFCLEFKRAASLLKYLPFPVTSMKDIQGLPCIGDQVRDVIEEIIEEGESSRVKEVLNDERYKAFKQFTSVFGVGVKTSEKWFRMGLRTVEEAKADKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 1029 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggtggggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcttctgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagagctgaaggccagtaagagtctgaagctgagcaagatgcagaaggcgggctttctgtattacgaggatctggccagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatggtctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1030 - protein, 394 aa, synthetic construct
  REGION 1..394: note = Variant of terminal deoxynucleotidyl transferase
MHHHHHHGGSGHPPSNTPEGGVPSVIARKVSQYSCQRKTTLNNYNKKFTDAFEIMAENYKFKENEIFCLEFKRAASLLKYLPFPVTSMKDIQGLPCIGDQVRDVIEEIIEEGESSRVKEVLNDERYKAFKQFTSVFGVGVKTSEKWFRMGLRTVEELKASKSLKLSKMQKAGFLYYEDLASCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 1031 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcggagcacgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1032 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEHERKMILDRHGLYDRKKRIFLKAGSEEEIFAHLGLDYVEPWERNA

SEQ ID NO: 1033 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1034 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1035 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggttagctgcgttagtaaagcggaagccgatgccgttacgctcatcgtgaagaacacggtgagtacctttctgccggatgcgctggtgaccatcaccggcggtttccgccgtggcaaaaagatgggccacgacatcgactttctgatcacgaatccgggcccgaaacaagatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttggtcgcgatctgcgccgctatgcggagcacgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1036 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLVSCVSKAEADAVTLIVKNTVSTFLPDALVTITGGFRRGKKMGHDIDFLITNPGPKQDDELLHKVVDLLKKQGLLLYCDIKESTFVEEQLPSRKIDAMDNFQKCFAILKLYQPGVDNSSYNTSKKSDMAEVKDWKAVRVDLVITPFEQYAYALLGWTGSKEFGRDLRRYAEHERKMILDRHGLYDRKKRIFLKAGSEEEIFAHLGLDYVEPWERNA

SEQ ID NO: 1037 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggttagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaagatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcggagcacgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1038 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLVSCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEHERKMILDRHGLYDRKKRIFLKAGSEEEIFAHLGLDYVEPWERNA

SEQ ID NO: 1039 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggctagctgcgttagtaaagcggaagccgatgccgttacgctcatcgtgaagaacacggtgagtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1040 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVSTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1041 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggcgagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcggagcacgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1042 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDAFEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEHERKMILDRHGLYDRKKRIFLKAGSEEEIFAHLGLDYVEPWERNA

SEQ ID NO: 1043 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggttagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcggagcacgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1044 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLVSCVSKAEADAVTLIVKNTVSTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEHERKMILDRHGLYDRKKRIFLKAGSEEEIFAHLGLDYVEPWERNA

SEQ ID NO: 1045 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggttagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1046 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLVSCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 1047 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgttggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgagtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcacgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1048 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVSTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 1049 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggctagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttggtcgcgatctgcgccgctatgcggagcacgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1050 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAVRVDLVITPFEQYAYALLGWTGSKEFGRDLRRYAEHERKMILDRHGLYDRKKRIFLKAGSEEEIFAHLGLDYVEPWERNA

SEQ ID NO: 1051 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggcgagctgcgttagtaaagcggaagccgatgccgttacgctcatcgtgaagaacacggtgagtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1052 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVSTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAVRVDLVITPFEQYAYALLGWTGSKEFGRDLRRYASHERKMILDRHGLYDRKKRIFLKAGSEEEIFAHLGLDYVEPWERNA

SEQ ID NO: 1053 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggctagctgcgttagtaaagcggaagccgatgccgttacgctcatcgtgaagaacacggtgagtacctttctgccggatgcgctggtgaccatcacgggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcggagcacgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1054 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVSTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEHERKMILDRHGLYDRKKRIFLKAGSEEEIFAHLGLDYVEPWERNA

SEQ ID NO: 1055 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttggtcgcgatctgcgccgctatgcgagtcacgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1056 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAVRVDLVITPFEQYAYALLGWTGSKEFGRDLRRYASHERKMILDRHGLYDRKKRIFLKAGSEEEIFAHLGLDYVEPWERNA

SEQ ID NO: 1057 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggcgagctgcgttagtaaagcggaagccgatgccgttacgctcatcgtgaagaacacggtgcgtacctttctgccggatgcgctggtgaccatcacgggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1058 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 1059 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgttcgagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagaaggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggctttctgtattacgaggatctggttagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcgagtcatgagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1060 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDAFEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLVSCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYASHERKMILDRHGLYDRKKRIFLKAGSEEEIFAHLGLDYVEPWERNA

SEQ ID NO: 1061 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctgcagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgatgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1062 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALQIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1063 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcctggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgatgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1064 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEILAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1065 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1066 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1067 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgatgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1068 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1069 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcctggccgagaactacaaatttaaagagaacgaaatcgcgtgtctggaatttaagcgcgccgcgagtctgctgaaatatctgccgttcccggttaccagcatgaaagacatccaaggtctgccgtgcattggccctcaagttcgtgatgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcggacagcgaagaagagattttcgcgcatctgggtctggattatgtggagccgtgggaacgcaacgcg

SEQ ID NO: 1070 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEILAENYKFKENEIACLEFKRAASLLKYLPFPVTSMKDIQGLPCIGPQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKADSEEEIFAHLGLDYVEPWERNA

SEQ ID NO: 1071 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgctgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagccgtgaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1072 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRAVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSREFGRDLRRYAEEERKMILDNHGLYDRKKRIFLKAGSEEEIFAHLGLDYVEPWERNA

SEQ ID NO: 1073 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaaactggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcctgctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1074 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIETGESSRVKEVLNDERYKAFKQFTSVFGVGVKTSEKWFRMGLRTVEEAKASKSLKLSKMQKAGLLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1075 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaaactggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcctgctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaacaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1076 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIETGESSRVKEVLNDERYKAFKQFTSVFGVGVKTSEKWFRMGLRTVEEAKASKSLKLSKMQKAGLLYYEDLASCVSKAEADAVTLIVKNTVRTFLPDALVTITGGFRRGKKMGHDIDFLITNPGPKQDDELLHKVVDLLKKQGLLLYCDIKESTFVEEQLPSRKIDAMDNFQKCFAILKLYQPGVDNSSYNTSKKSDMAEVKDWKAVRVDLVITPFEQYAYALLGWTGSKEFGRDLRRYAEEERKMILDRHGLYDRKKRIFLKAGSEEEIFAHLGLDYVEPWERNA

SEQ ID NO: 1077 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcctggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgatgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacggcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagccgtgaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1078 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEILAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYGDIKESTFVEEQLPSRKIDAMDNFQKCFAILKLYQPGVDNSSYNTSKKSDMAEVKDWKAIRVDLVITPFEQYAYALLGWTGSREFGRDLRRYAEEERKMILDRHGLYDRKKRIFLKAGSEEEIFAHLGLDYVEPWERNA

SEQ ID NO: 1079 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcctggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgatgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgcgctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1080 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEILAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLARCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1081 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcctggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgatgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1082 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEILAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1083 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcctgctgtattacgaggatctggcgagctgcgttagtaaagcggaagccgatgccgttacgctcatcgtgaagaacacggtgcgcacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataatagcgcgtataacacgagtaagaagagtgacatggccgaggttaaggattggaaagcgatccgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1084 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGLLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSAYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1085 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcctggccgagaactacaaatttaaagagaacgaaatcgcgtgtctggaatttaagcgcgccgcgagtctgctgaaatatctgccgttcccggttaccagcatgaaagacatccaaggtctgccgtgcattggccctcaagttcgtgctgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1086 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEILAENYKFKENEIACLEFKRAASLLKYLPFPVTSMKDIQGLPCIGPQVRAVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1087 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgctgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1088 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRAVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIIESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1089 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcctggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgctgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1090 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEILAENYKFKENEIACLEFKRAASLLKYLPFPVTSMKDIQGLPCIGDQVRAVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1091 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtacggcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1092 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYGDIIESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1093 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcctggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgcgctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1094 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEILAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLARCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1095 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcctggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgcgctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatgggctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1096 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEILAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLARCVSKAEADAVTLIVKNTVRTFLPDALVTITGGFRRGKKMGHDIDFLITNPGPKEDDELLHKVVDGLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1097 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgctgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1098 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRAVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1099 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatccgtgagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcctgctgtattacgaggatctggcgagctgcgttagtaaagcggaagccgatgccgttacgctcatcgtgaagaacacggtgagcacctttctgccggatgcgctggtgaccatcaccggcggtttccgccgtggcaaaaagatgggccacgacatcgactttctgatcacgaatccgggcccgaaacaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1100 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIREIIEEGESSRVKEVLNDERYKAFKQFTSVFGVGVKTSEKWFRMGLRTVEEAKASKSLKLSKMQKAGLLYYEDLASCVSKAEADAVTLIVKNTVSTFLPDALVTITGGFRRGKKMGHDIDFLITNPGPKQDDELLHKVVDLLKKQGLLLYCDIKESTFVEEQLPSRKIDAMDNFQKCFAILKLYQPGVDNSSYNTSKKSDMAEVKDWKAVRVDLVITPFEQYAYALLGWTGSKEFGRDLRRYAEEERKMILDRHGLYDRKKRIFLKAGSEEEIFAHLGLDYVEPWERNA

SEQ ID NO: 1101 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgatgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgcgctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1102 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLARCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1103 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcctggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgatgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtacggcgacatcatcgagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1104 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEILAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYGDIIESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1105 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatccgtgagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcctgctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataatagctcgtataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtgcagccgtgggaacgcaacgcg

SEQ ID NO: 1106 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIREIIEEGESSRVKEVLNDERYKAFKQFTSVFGVGVKTSEKWFRMGLRTVEEAKASKSLKLSKMQKAGLLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVQPWERNA

SEQ ID NO: 1107 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1108 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1109 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgctgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtacggcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1110 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRAVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYGDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1111 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcctgctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1112 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGLLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1113 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggccctcaagttcgtgctgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1114 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGPQVRAVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1115 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcctggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgctgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagccgtgaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1116 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEILAENYKFKENEIACLEFKRAASLLKYLPFPVTSMKDIQGLPCIGDQVRAVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSREFGRDLRRYAEEERKMILDRHGLYDRKKRIFLKAGSEEEIFAHLGLDYVEPWERNA

SEQ ID NO: 1117 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgatgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtacggcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1118 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYGDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1119 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcctggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgctgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgcgctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1120 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEILAENYKFKENEIACLEFKRAASLLKYLPFPVTSMKDIQGLPCIGDQVRAVIEEIIEEGESSRVKEVLNDERYKAFKQFTSVFGVGVKTSEKWFRMGLRTVEEAKASKSLKLSKMQKAGFLYYEDLARCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1121 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgatgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1122 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1123 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1124 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1125 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatggtgctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1126 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMVLDRHGLYDRKKRIFLKAGSEEEIFAHLGLDYVEPWERNA

SEQ ID NO: 1127 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacttatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1128 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKLMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1129 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtgttctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1130 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASVLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1131 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaagtgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1132 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENESACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1133 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggtgtttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1134 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLVFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1135 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1136 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1137 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgaggattacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1138 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAEDYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1139 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaagcgaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1140 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEAKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1141 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgtttaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1142 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLFKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1143 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcggggcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1144 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRGASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1145 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacttttatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1146 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYFYALLGWTGSKEFGRDLRRYAEEERKMILDRHGLYDRKKRIFLKAGSEEEIFAHLGLDYVEPWERNA

SEQ ID NO: 1147 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgcggtatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1148 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLRYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1149 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaagttatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1150 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKVMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1151 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcctggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgatgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1152 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEILAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1153 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggtggagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1154 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMVENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1155 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcggcggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1156 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDAAEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1157 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaagtttggtgagaacgaaatcgcgtgcctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1158 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFGENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1159 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaccggcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1160 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEPACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1161 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagactaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1162 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKTTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1163 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgctcgatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1164 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERSMILDRHGLYDRKKRIFLKAGSEEEIFAHLGLDYVEPWERNA

SEQ ID NO: 1165 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggagacggagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1166 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAETERKMILDRHGLYDRKKRIFLKAGSEEEIFAHLGLDYVEPWERNA

SEQ ID NO: 1167 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctggtgcgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1168 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLVRYAEEERKMILDRHGLYDRKKRIFLKAGSEEEIFAHLGLDYVEPWERNA

SEQ ID NO: 1169 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcatgatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1170 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERMMILDRHGLYDRKKRIFLKAGSEEEIFAHLGLDYVEPWERNA

SEQ ID NO: 1171 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttctatagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1172 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFYSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1173 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggcttttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1174 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLAFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1175 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatccgggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1176 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIRAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1177 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagatgtacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1178 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAEMYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1179 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccgtggtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1180 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTVVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1181 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaacagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1182 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEQRKMILDRHGLYDRKKRIFLKAGSEEEIFAHLGLDYVEPWERNA

SEQ ID NO: 1183 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtattgaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1184 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACIEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1185 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagagggaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1186 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKEREIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1187 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagtcttacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1188 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAESYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1189 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacagttatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1190 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYSYALLGWTGSKEFGRDLRRYAEEERKMILDRHGLYDRKKRIFLKAGSEEEIFAHLGLDYVEPWERNA

SEQ ID NO: 1191 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagtcgaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1192 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEESKMILDRHGLYDRKKRIFLKAGSEEEIFAHLGLDYVEPWERNA

SEQ ID NO: 1193 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggtatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1194 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDRHGLYDRKKRIFLKAGSEEEIFAHLGLDYVEPWERNA

SEQ ID NO: 1195 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaattttgggagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1196 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFWENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1197 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatggctctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1198 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMALDRHGLYDRKKRIFLKAGSEEEIFAHLGLDYVEPWERNA

SEQ ID NO: 1199 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggagtcggagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1200 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAESERKMILDRHGLYDRKKRIFLKAGSEEEIFAHLGLDYVEPWERNA

SEQ ID NO: 1201 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagggggccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1202 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKGAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1203 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttagggagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1204 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFRENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1205 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagtgttacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1206 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAECYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1207 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctgcattttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1208 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLHFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1209 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaaggtgttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1210 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKVFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1211 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccatggtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1212 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTMVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1213 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagaatatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1214 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALENMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1215 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggattttgtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1216 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDFVITPFEQYAYALLGWTGSKEFGRDLRRYAEEERKMILDRHGLYDRKKRIFLKAGSEEEIFAHLGLDYVEPWERNA

SEQ ID NO: 1217 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggcctgtaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1218 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMACNYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1219 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgccagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1220 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERQMILDRHGLYDRKKRIFLKAGSEEEIFAHLGLDYVEPWERNA

SEQ ID NO: 1221 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgaccttctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1222 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDLLEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1223 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtataccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1224 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKYTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1225 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcagtccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1226 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVISPFEQYAYALLGWTGSKEFGRDLRRYAEEERKMILDRHGLYDRKKRIFLKAGSEEEIFAHLGLDYVEPWERNA

SEQ ID NO: 1227 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatcgaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1228 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLESKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1229 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagaggctaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1230 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEEAKMILDRHGLYDRKKRIFLKAGSEEEIFAHLGLDYVEPWERNA

SEQ ID NO: 1231 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagcaggaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1232 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKEQEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1233 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttggggagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1234 - protein, 394 aa, synthetic construct; identical to SEQ ID NO: 1158
  REGION 1..394: note = Variant of terminal deoxynucleotidyl transferase

SEQ ID NO: 1235 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactggaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1236 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENWKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1237 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaacagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1238 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKQFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1239 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtggtgacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1240 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVVTPFEQYAYALLGWTGSKEFGRDLRRYAEEERKMILDRHGLYDRKKRIFLKAGSEEEIFAHLGLDYVEPWERNA

SEQ ID NO: 1241 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaaacgaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1242 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKTKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1243 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcagcgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1244 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLQRYAEEERKMILDRHGLYDRKKRIFLKAGSEEEIFAHLGLDYVEPWERNA

SEQ ID NO: 1245 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctggctcgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1246 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLARYAEEERKMILDRHGLYDRKKRIFLKAGSEEEIFAHLGLDYVEPWERNA

SEQ ID NO: 1247 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgtgtggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1248 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALCGWTGSKEFGRDLRRYAEEERKMILDRHGLYDRKKRIFLKAGSEEEIFAHLGLDYVEPWERNA

SEQ ID NO: 1249 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctgatttttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1250 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLIFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1251 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattctctcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1252 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFSQYAYALLGWTGSKEFGRDLRRYAEEERKMILDRHGLYDRKKRIFLKAGSEEEIFAHLGLDYVEPWERNA

SEQ ID NO: 1253 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgactctctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1254 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDSLEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1255 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtactggtatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1256 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYWYALLGWTGSKEFGRDLRRYAEEERKMILDRHGLYDRKKRIFLKAGSEEEIFAHLGLDYVEPWERNA

SEQ ID NO: 1257 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgttgctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1258 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMLLDRHGLYDRKKRIFLKAGSEEEIFAHLGLDYVEPWERNA

SEQ ID NO: 1259 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagattaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1260 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKITDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1261 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacccttatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1262 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYPYALLGWTGSKEFGRDLRRYAEEERKMILDRHGLYDRKKRIFLKAGSEEEIFAHLGLDYVEPWERNA

SEQ ID NO: 1263 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagataacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1264 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKDNEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1265 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaagggcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1266 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENERACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1267 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggaggtgatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaaaagatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgaccgtcatggcctctacgaccgcaaaaagcgcatctttctgaaagcgggcagcgaagaagagattttcgcgcatctgggtctggattatgtggagccgtgggaacgcaacgcg

SEQ ID NO: 1268 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEVMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKKMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDRHGLYDRKKRIFLKAGSEEEIFAHLGLDYVEPWERNA

SEQ ID NO: 1269 - DNA, 1182 bp, synthetic construct; identical to SEQ ID NO: 1065
  misc_feature 1..1182: note = Variant of terminal deoxynucleotidyl transferase
  source 1..1182: mol_type = other DNA

SEQ ID NO: 1270 - protein, 394 aa, synthetic construct; identical to SEQ ID NO: 1066
  REGION 1..394: note = Variant of terminal deoxynucleotidyl transferase

SEQ ID NO: 1271 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcgaggaagaagagattttcgcgcatctgggtctggattatgtggagccgtgggaacgcaacgcg

SEQ ID NO: 1272 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGEEEEIFAHLGLDYVEPWERNA

SEQ ID NO: 1273 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagacctctctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1274 - protein, 394 aa, synthetic construct
  REGION 1..394: note = Variant of terminal deoxynucleotidyl transferase
MHHHHHHGGSGHPPSNTPEGEVPSVIARKVSQYSCQRKTSLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1275 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagatgaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1276 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKDEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1277 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgcttagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1278 - protein, 394 aa, synthetic construct
  REGION 1..394: note = Variant of terminal deoxynucleotidyl transferase
MHHHHHHGGSGHPPSNTPEGEVLSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1279 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagcattaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1280 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKHYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1281 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcattacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1282 - protein, 394 aa, synthetic construct
  REGION 1..394: note = Variant of terminal deoxynucleotidyl transferase
MHHHHHHGGSGHPPSNTPEGEVPSVIARKVSHYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1283 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgagaagaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1284 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEKKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1285 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggggatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1286 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEGIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1287 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaacgggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1288 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKREADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1289 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaacagctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1290 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQQLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1291 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttagtgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1292 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFSDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1293 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaaaatattttcgcgcatctgggtctggattatgtggagccgtgggaacgcaacgcg

SEQ ID NO: 1294 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEENIFAHLGLDYVEPWERNA

SEQ ID NO: 1295 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgaggagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1296 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLRSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1297 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaatggctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1298 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQWLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1299 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcggggaagaagagattttcgcgcatctgggtctggattatgtggagccgtgggaacgcaacgcg

SEQ ID NO: 1300 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGGEEEIFAHLGLDYVEPWERNA

SEQ ID NO: 1301 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggatgtggtggagccgtgggaacgcaacgcg

SEQ ID NO: 1302 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDVVEPWERNA

SEQ ID NO: 1303 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtattaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1304 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRIKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1305 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagcggtgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1306 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASGVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1307 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgagagtatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1308 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIESIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1309 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccatcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1310 - protein, 394 aa, synthetic construct
  REGION 1..394: note = Variant of terminal deoxynucleotidyl transferase
MHHHHHHGGSGHPPSNTPEGEVPSVIARKVSQYSCHRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1311 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacccgcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1312 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDPRYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1313 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattccggaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1314 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIPDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1315 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagatgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1316 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKMSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1317 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagactgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1318 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEETESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1319 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcagaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1320 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSQKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1321 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaaactctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1322 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKETLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1323 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatgcgctctacgaccgcaaaaagcgcatctttctgaaagcgggcagcgaagaagagattttcgcgcatctgggtctggattatgtggagccgtgggaacgcaacgcg

SEQ ID NO: 1324 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHALYDRKKRIFLKAGSEEEIFAHLGLDYVEPWERNA

SEQ ID NO: 1325 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaacgcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1326 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPTRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1327 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagtgtttcgcgcatctgggtctggattatgtggagccgtgggaacgcaacgcg

SEQ ID NO: 1328 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEECFAHLGLDYVEPWERNA

SEQ ID NO: 1329 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgggttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1330 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1331 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtggtgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1332 - protein, 394 aa, synthetic construct
  REGION 1..394: note = Variant of terminal deoxynucleotidyl transferase
MHHHHHHGGSGHPPSNTPEGEVVSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1333 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagggggcagcgaagaagagattttcgcgcatctgggtctggattatgtggagccgtgggaacgcaacgcg

SEQ ID NO: 1334 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKGGSEEEIFAHLGLDYVEPWERNA

SEQ ID NO: 1335 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactggctagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1336 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLASRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1337 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagaggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1338 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKEEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1339 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcggggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1340 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGGDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1341 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacgaaatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagcgcggttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1342 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENEIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASAVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1343 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1344 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1345 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1346 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1347 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcactagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcatgatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1348 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERMMILDNHGLYDRKKRIFLKAGSEEEIFAHLGLDYVEPWERNA

SEQ ID NO: 1349 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1350 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1351 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1352 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1353 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcactagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1354 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1355 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagtcgtacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaggagcgcaagatgatcctcgacaaccatggcctctacgaccgcaaaaagcgcatctttctgaaagcgggtagcgaagaagagattttcgcgcatctgggtctggattatgtggagccgtgggaacgcaacgcg

SEQ ID NO: 1356 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAESYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1357 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcactgtggtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1358 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASILKYLPFPVTSMKDIQGLPCIGDQVRDVIEEIIEEGESSRVKEVLNDERYKAFKQFTVVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1359 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcactagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcatgatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1360 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERMMILDNHGLYDRKKRIFLKAGSEEEIFAHLGLDYVEPWERNA

SEQ ID NO: 1361 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggtatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcatgatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1362 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLVFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERMMILDNHGLYDRKKRIFLKAGSEEEIFAHLGLDYVEPWERNA

SEQ ID NO: 1363 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcactgtggtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1364 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTVVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1365 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagtcgtacaaatttaaagagaatctgatcgcgtgtattgaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcggatagcgaagaagagattttcgcgcatctgggtctggattatgtggagccgtgggaacgcaacgcg

SEQ ID NO: 1366 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAESYKFKENLIACIEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKADSEEEIFAHLGLDYVEPWERNA

SEQ ID NO: 1367 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggtatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcactatggtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1368 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLVFKRAASLLKYLPFPVTSMKDIQGLPCIGDQVRDVIEEIIEEGESSRVKEVLNDERYKAFKQFTMVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1369 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggtagccaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcactagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1370 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLVAKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1371 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgaggattacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgtgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggtagcgaagaagagattttcgcgcatctgggtctggattatgtggagccgtgggaacgcaacgcg

SEQ ID NO: 1372 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAEDYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1373 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggtagccaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcactagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1374 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLVAKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1375 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagtcgtacaaatttaaagagaacctgatcgcgtgtctggaatttaagcgcgccgcgagtctgctgaaatatctgccgttcccggttaccagcatgaaagacatccaaggtctgccgtgcattggcgtccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgtgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggagcagcgcaagatggccctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1376 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAESYKFKENLIACLEFKRAASLLKYLPFPVTSMKDIQGLPCIGVQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEQRKMALDNHGLYDRKKRIFLKAGSEEEIFAHLGLDYVEPWERNA

SEQ ID NO: 1377 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaattacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgtgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggagtcggagcgcaagatgatcctcgacaaccatggcctctacgaccgcaaaaagcgcatctttctgaaagcgggtagcgaagaagagattttcgcgcatctgggtctggattatgtggagccgtgggaacgcaacgcg

SEQ ID NO: 1378 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAESERKMILDNHGLYDRKKRIFLKAGSEEEIFAHLGLDYVEPWERNA

SEQ ID NO: 1379 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatccgtgccgaggattacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggagtcggagcgcaagatgatcctcgacaaccatggcctctacgaccgcaaaaagcgcatctttctgaaagcggatagcgaagaagagattttcgcgcatctgggtctggattatgtggagccgtgggaacgcaacgcg

SEQ ID NO: 1380 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIRAEDYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFGRDLRRYAESERKMILDNHGLYDRKKRIFLKADSEEEIFAHLGLDYVEPWERNA

SEQ ID NO: 1381 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaattacaaatttaaagagaacctgatcgcgtgtctggaatttaagcgcgccgcgagtctgctgaaatatctgccgttcccggttaccagcatgaaagacatccaaggtctgccgtgcattggcgtccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggagcagcgcaagatggccctcgacaaccatggcctctacgaccgcaaaaagcgcatctttctgaaagcgggtagcgaagaagagattttcgcgcatctgggtctggattatgtggagccgtgggaacgcaacgcg

SEQ ID NO: 1382 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGVQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEQRKMALDNHGLYDRKKRIFLKAGSEEEIFAHLGLDYVEPWERNA

SEQ ID NO: 1383 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1384 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1385 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatccgtgccgagtcgtacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgtgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggagtcgcagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1386 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIRAESYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAESQRKMILDNHGLYDRKKRIFLKAGSEEEIFAHLGLDYVEPWERNA

SEQ ID NO: 1387 - DNA, 1182 bp, synthetic construct; identical to SEQ ID NO: 1349
  misc_feature 1..1182: note = Variant of terminal deoxynucleotidyl transferase
  source 1..1182: mol_type = other DNA

SEQ ID NO: 1388 - protein, 394 aa, synthetic construct; identical to SEQ ID NO: 1350
  REGION 1..394: note = Variant of terminal deoxynucleotidyl transferase

SEQ ID NO: 1389 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatccgtgccgagatgtacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgtgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1390 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIRAEMYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1391 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggtatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcactagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1392 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLVFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1393 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatccgtgccgagtcgtacaaatttaaagagaacctgatcgcgtgtctggaatttaagcgcgccgcgagtctgctgaaatatctgccgttcccggttaccagcatgaaagacatccaaggtctgccgtgcattggcgtccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgtgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggagcagcgcaagatgatcctcgacaaccatggcctctacgaccgcaaaaagcgcatctttctgaaagcgggtagcgaagaagagattttcgcgcatctgggtctggattatgtggagccgtgggaacgcaacgcg

SEQ ID NO: 1394 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIRAESYKFKENLIACLEFKRAASLLKYLPFPVTSMKDIQGLPCIGVQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEQRKMILDNHGLYDRKKRIFLKAGSEEEIFAHLGLDYVEPWERNA

SEQ ID NO: 1395 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagtcgtacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggagtcggagcgcaagatggtcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1396 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAESYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAESERKMVLDNHGLYDRKKRIFLKAGSEEEIFAHLGLDYVEPWERNA

SEQ ID NO: 1397 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatccgtgccgagtcgtacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaagaggagcgcaagatggccctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1398 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIRAESYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMALDNHGLYDRKKRIFLKAGSEEEIFAHLGLDYVEPWERNA

SEQ ID NO: 1399 - DNA, 1182 bp, synthetic construct; identical to SEQ ID NO: 1351
  misc_feature 1..1182: note = Variant of terminal deoxynucleotidyl transferase
  source 1..1182: mol_type = other DNA

SEQ ID NO: 1400 - protein, 394 aa, synthetic construct; identical to SEQ ID NO: 1352
  REGION 1..394: note = Variant of terminal deoxynucleotidyl transferase

SEQ ID NO: 1401 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatccgtgccgagatgtacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaggagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1402 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIRAEMYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1403 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagatgtacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggagtcggagcgcaagatggtcctcgacaaccatggcctctacgaccgcaaaaagcgcatctttctgaaagcgggtagcgaagaagagattttcgcgcatctgggtctggattatgtggagccgtgggaacgcaacgcg

SEQ ID NO: 1404 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAEMYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFGRDLRRYAESERKMVLDNHGLYDRKKRIFLKAGSEEEIFAHLGLDYVEPWERNA

SEQ ID NO: 1405 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttctatagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1406 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASILKYLPFPVTSMKDIQGLPCIGDQVRDVIEEIIEEGESSRVKEVLNDERYKAFKQFYSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1407 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttctatagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcatgatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1408 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFYSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERMMILDNHGLYDRKKRIFLKAGSEEEIFAHLGLDYVEPWERNA

SEQ ID NO: 1409 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1410 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1411 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatccgtgccgagtcgtacaaatttaaagagaacctgatcgcgtgtctggaatttaagcgcgccgcgagtctgctgaaatatctgccgttcccggttaccagcatgaaagacatccaaggtctgccgtgcattggcgtccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggagcagcgcaagatgatcctcgacaaccatggcctctacgaccgcaaaaagcgcatctttctgaaagcggatagcgaagaagagattttcgcgcatctgggtctggattatgtggagccgtgggaacgcaacgcg

SEQ ID NO: 1412 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIRAESYKFKENLIACLEFKRAASLLKYLPFPVTSMKDIQGLPCIGVQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEQRKMILDNHGLYDRKKRIFLKADSEEEIFAHLGLDYVEPWERNA

SEQ ID NO: 1413 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctgttatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcactagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1414 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLLFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1415 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgaggattacaaatttaaagagaacctgatcgcgtgtctggaatttaagcgcgccgcgagtctgctgaaatatctgccgttcccggttaccagcatgaaagacatccaaggtctgccgtgcattggcgtccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgtgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaggagcgcaagatggtcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1416 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAEDYKFKENLIACLEFKRAASLLKYLPFPVTSMKDIQGLPCIGVQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMVLDNHGLYDRKKRIFLKAGSEEEIFAHLGLDYVEPWERNA

SEQ ID NO: 1417 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatccgtgccgagatgtacaaatttaaagagaacctgatcgcgtgtattgaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgtgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggagtcgcagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1418 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIRAEMYKFKENLIACIEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAESQRKMILDNHGLYDRKKRIFLKAGSEEEIFAHLGLDYVEPWERNA

SEQ ID NO: 1419 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcatgatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1420 - protein, 394 aa, synthetic construct; identical to SEQ ID NO: 1360
  REGION 1..394: note = Variant of terminal deoxynucleotidyl transferase

SEQ ID NO: 1421 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagtcgtacaaatttaaagagaacctgatcgcgtgtctggaatttaagcgcgccgcgagtctgctgaaatatctgccgttcccggttaccagcatgaaagacatccaaggtctgccgtgcattggcgtccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgtgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1422 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAESYKFKENLIACLEFKRAASLLKYLPFPVTSMKDIQGLPCIGVQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1423 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttctatagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcatgatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1424 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASILKYLPFPVTSMKDIQGLPCIGDQVRDVIEEIIEEGESSRVKEVLNDERYKAFKQFYSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERMMILDNHGLYDRKKRIFLKAGSEEEIFAHLGLDYVEPWERNA

SEQ ID NO: 1425 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgtgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaggagcgcaagatggtcctcgacaaccatggcctctacgaccgcaaaaagcgcatctttctgaaagcggatagcgaagaagagattttcgcgcatctgggtctggattatgtggagccgtgggaacgcaacgcg

SEQ ID NO: 1426 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMVLDNHGLYDRKKRIFLKADSEEEIFAHLGLDYVEPWERNA

SEQ ID NO: 1427 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatccgtgccgagtcgtacaaatttaaagagaacctgatcgcgtgtctggaatttaagcgcgccgcgagtctgctgaaatatctgccgttcccggttaccagcatgaaagacatccaaggtctgccgtgcattggcgtccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaggagcgcaagatggccctcgacaaccatggcctctacgaccgcaaaaagcgcatctttctgaaagcgggtagcgaagaagagattttcgcgcatctgggtctggattatgtggagccgtgggaacgcaacgcg

SEQ ID NO: 1428 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIRAESYKFKENLIACLEFKRAASLLKYLPFPVTSMKDIQGLPCIGVQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMALDNHGLYDRKKRIFLKAGSEEEIFAHLGLDYVEPWERNA

SEQ ID NO: 1429 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttctatagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1430 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFYSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1431 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1432 - protein, 394 aa, synthetic construct
  REGION 1..394: note = Variant of terminal deoxynucleotidyl transferase
MHHHHHHGDSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1433 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgctcttttctgaaagcgggcagcgaagaagagattttcgcgcatctgggtctggattatgtggagccgtgggaacgcaacgcg

SEQ ID NO: 1434 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRSFLKAGSEEEIFAHLGLDYVEPWERNA

SEQ ID NO: 1435 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgggcatctgggtctggattatgtggagccgtgggaacgcaacgcg

SEQ ID NO: 1436 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFGHLGLDYVEPWERNA

SEQ ID NO: 1437 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcaggaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1438 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGRKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1439 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtgcgaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1440 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSAKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1441 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcggtaccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1442 - protein, 394 aa, synthetic construct
  REGION 1..394: note = Variant of terminal deoxynucleotidyl transferase
MHHHHHHGGSGHPPSGTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1443 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgacgaggttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1444 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDEVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1445 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgggggacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1446 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMGDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1447 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtggttttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1448 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRGFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1449 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaaggggacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1450 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKGTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1451 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgactggaaaaagcgcatctttctgaaagcgggcagcgaagaagagattttcgcgcatctgggtctggattatgtggagccgtgggaacgcaacgcg

SEQ ID NO: 1452 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDWKKRIFLKAGSEEEIFAHLGLDYVEPWERNA

SEQ ID NO: 1453 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtgggaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1454 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSGKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1455 - DNA, 1182 bp, synthetic construct
  misc_feature 1..1182: note = Variant of terminal deoxynucleotidyl transferase
  source 1..1182: mol_type = other DNA
atgcaccatcatcatcatcatagtggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1456 - protein, 394 aa, synthetic construct
  REGION 1..394: note = Variant of terminal deoxynucleotidyl transferase
MHHHHHHSGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1457 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagcgataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1458 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSDNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1459 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgcggagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1460 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDAELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1461 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcagggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1462 - protein, 394 aa, synthetic construct
  REGION 1..394: note = Variant of terminal deoxynucleotidyl transferase
MHHHHHHGGSGHPPSNTPEGEVPSVIARRVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1463 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatggggagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1464 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDGELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1465 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgtatgacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1466 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMYDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1467 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccggggagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1468 - protein, 394 aa, synthetic construct
  REGION 1..394: note = Variant of terminal deoxynucleotidyl transferase
MHHHHHHGGSGHPGSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1469 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgactttaaaaagcgcatctttctgaaagcgggcagcgaagaagagattttcgcgcatctgggtctggattatgtggagccgtgggaacgcaacgcg

SEQ ID NO: 1470 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDFKKRIFLKAGSEEEIFAHLGLDYVEPWERNA

SEQ ID NO: 1471 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccggagagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1472 - protein, 394 aa, synthetic construct
  REGION 1..394: note = Variant of terminal deoxynucleotidyl transferase
MHHHHHHGGSGHPESNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1473 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctggttaactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1474 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLVNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1475 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctggggcagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1476 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLGQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1477 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgccgggaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1478 - protein, 394 aa, synthetic construct
  REGION 1..394: note = Variant of terminal deoxynucleotidyl transferase
MHHHHHHGGSGHPPSNTPEGEVPSVIAGKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1479 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgtggttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1480 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADVVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1481 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccggagaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1482 - protein, 394 aa, synthetic construct
  REGION 1..394: note = Variant of terminal deoxynucleotidyl transferase
MHHHHHHGGSGHPPENTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1483 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagcttggttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1484 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSLVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1485 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagaagtacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1486 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDEKYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1487 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgacctgaaaaagcgcatctttctgaaagcgggcagcgaagaagagattttcgcgcatctgggtctggattatgtggagccgtgggaacgcaacgcg

SEQ ID NO: 1488 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDLKKRIFLKAGSEEEIFAHLGLDYVEPWERNA

SEQ ID NO: 1489 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgagagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1490 - protein, 394 aa, synthetic construct
  REGION 1..394: note = Variant of terminal deoxynucleotidyl transferase
MHHHHHHGESGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1491 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgattagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1492 - protein, 394 aa, synthetic construct
  REGION 1..394: note = Variant of terminal deoxynucleotidyl transferase
MHHHHHHGGSGHPISNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1493 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagcgtgaacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1494 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSVNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1495 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcctcgaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1496 - protein, 394 aa, synthetic construct
  REGION 1..394: note = Variant of terminal deoxynucleotidyl transferase
MHHHHHHGGSGHPPSNTPEGEVPSVIASKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1497 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttcagagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1498 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVQSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1499 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttactcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1500 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFTRDLRRYAEEERKMILDNHGLYDRKKRIFLKAGSEEEIFAHLGLDYVEPWERNA

SEQ ID NO: 1501 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagactgtcaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1502 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDCQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1503 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatcgtgggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1504 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIVGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1505 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacgtgcaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1506 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDVQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1507 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttgagcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1508 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFERDLRRYAEEERKMILDNHGLYDRKKRIFLKAGSEEEIFAHLGLDYVEPWERNA

SEQ ID NO: 1509 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatggatgacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1510 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMDDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1511 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaaggtggacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1512 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKVDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1513 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgtgtaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1514 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVCNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1515 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcggtaagcgcatctttctgaaagcgggcagcgaagaagagattttcgcgcatctgggtctggattatgtggagccgtgggaacgcaacgcg

SEQ ID NO: 1516 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRGKRIFLKAGSEEEIFAHLGLDYVEPWERNA

SEQ ID NO: 1517 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgatgttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1518 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMADVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1519 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctctggaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1520 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLWKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1521 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcctgaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1522 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLLKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1523 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggagcagcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1524 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEQQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1525 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggactcgttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1526 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDSFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1527 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgccattaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1528 - protein, 394 aa, synthetic construct
  REGION 1..394: note = Variant of terminal deoxynucleotidyl transferase
MHHHHHHGGSGHPPSNTPEGEVPSVIAIKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1529 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgtttaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1530 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVFNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1531 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaggaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1532 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVRNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1533 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaggacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1534 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKRTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1535 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagttttacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1536 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDEFYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1537 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcggtcatctgggtctggattatgtggagccgtgggaacgcaacgcg

SEQ ID NO: 1538 - protein, 394 aa, synthetic construct; identical to SEQ ID NO: 1436
  REGION 1..394: note = Variant of terminal deoxynucleotidyl transferase

SEQ ID NO: 1539 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgaggcgtacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1540 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDEAYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1541 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatctttggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1542 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIFGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1543 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacattatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1544 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDIIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1545 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacggatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1546 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITDPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1547 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcggtatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1548 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRGIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1549 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgcaggaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1550 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPQEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1551 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgattccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1552 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITIPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1553 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatgctggaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1554 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMLEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1555 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgacaataaaaagcgcatctttctgaaagcgggcagcgaagaagagattttcgcgcatctgggtctggattatgtggagccgtgggaacgcaacgcg

SEQ ID NO: 1556 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDNKKRIFLKAGSEEEIFAHLGLDYVEPWERNA

SEQ ID NO: 1557 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaactgtgtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1558 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNCVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1559 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagcacggttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1560 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSTVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1561 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcatgcatctgggtctggattatgtggagccgtgggaacgcaacgcg

SEQ ID NO: 1562 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFMHLGLDYVEPWERNA

SEQ ID NO: 1563 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatcgcgggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1564 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIAGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1565 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaatttaagcgcgccgcgagtctgctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtctgtttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcaagatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1566 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEFKRAASLLKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRLFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERKMILDNHGLYDRKKRIFLKAGSEEEIFAHLGLDYVEPWERNA

SEQ ID NO: 1567 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgcttgatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1568 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLLDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1569 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgagggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1570 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLRDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1571 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgatggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1572 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLMDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1573 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgccgggaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1574 - protein, 394 aa, synthetic construct
  REGION 1..394: note = Variant of terminal deoxynucleotidyl transferase
MHHHHHHGGSGHPPSNTPEGEVPSVIAGKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1575 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtacgtgccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1576 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYVPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1577 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcctgctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1578 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGLLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1579 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagacgagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1580 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKTSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1581 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtaccgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1582 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWYRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1583 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccgtccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1584 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYRPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1585 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgccgagaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1586 - protein, 394 aa, synthetic construct
  REGION 1..394: note = Variant of terminal deoxynucleotidyl transferase
MHHHHHHGGSGHPPSNTPEGEVPSVIAEKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1587 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaaggggagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1588 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKGSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1589 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagcgggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1590 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQRAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1591 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatcgaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1592 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIEGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1593 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattgcggaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1594 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIADQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1595 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcactaatccgggcccgaaagaagatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1596 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFEVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1597 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgattgatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1598 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLIDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1599 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcgcttataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1600 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSAYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1601 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgcttctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1602 - protein, 394 aa, synthetic construct; identical to SEQ ID NO: 1346
  REGION 1..394: note = Variant of terminal deoxynucleotidyl transferase

SEQ ID NO: 1603 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaaggagacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1604 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKETVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1605 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattactgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1606 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1607 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacggtgatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1608 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTVIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1609 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgtttgatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1610 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLFDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1611 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgagtatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1612 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTSIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1613 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaaggctctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1614 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKALKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1615 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtcgtgcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1616 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSRAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1617 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcttggagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1618 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIILEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1619 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgctgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1620 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTAEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1621 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgctgtgttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1622 - protein, 394 aa, synthetic construct
  REGION 1..394: note = Variant of terminal deoxynucleotidyl transferase
MHHHHHHGGSGHPPSNTPEGEVPSVIARCVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1623 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatccttcgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcactaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1624 - protein, 394 aa, synthetic construct
  REGION 1..394: note = Variant of terminal deoxynucleotidyl transferase
MHHHHHHGGSGHPPSNTPEGEVPSVILRKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1625 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcacgtgccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1626 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEARASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1627 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgcgtatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1628 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTRIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1629 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctggaggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcttggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaattaggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1630 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLEDALVTITGGFRRGKPMGHDIDFLITNPGPKEDDELLHKVVDLLKKQGLLLYCDIKESTFLEEQLPSRKIDAMDNFQKCFAILKLYQPGVDNSSYNTSKKSDMAEVKDWKAIRVDLVITPFEQYAYALLGWTGSKELGRDLRRYAEEERGMILDNHGLYDRKKRIFLKAGSEEEIFAHLGLDYVEPWERNA

SEQ ID NO: 1631 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcatgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1632 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFMYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1633 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1634 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1635 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgaggtgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtatcagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1636 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLARCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1637 - DNA, 1182 bp, synthetic construct; identical to SEQ ID NO: 1581
  misc_feature 1..1182: note = Variant of terminal deoxynucleotidyl transferase
  source 1..1182: mol_type = other DNA

SEQ ID NO: 1638 - protein, 394 aa, synthetic construct; identical to SEQ ID NO: 1582
  REGION 1..394: note = Variant of terminal deoxynucleotidyl transferase

SEQ ID NO: 1639 - DNA, 1182 bp, synthetic construct; identical to SEQ ID NO: 1615
  misc_feature 1..1182: note = Variant of terminal deoxynucleotidyl transferase
  source 1..1182: mol_type = other DNA

SEQ ID NO: 1640 - protein, 394 aa, synthetic construct; identical to SEQ ID NO: 1616
  REGION 1..394: note = Variant of terminal deoxynucleotidyl transferase

SEQ ID NO: 1641 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtggagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1642 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVENTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1643 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcgaaaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1644 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGEKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1645 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgggggcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1646 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLGACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1647 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccaatcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1648 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPIEQYAYALLGWTGSKEFGRDLRRYAEEERGMILDNHGLYDRKKRIFLKAGSEEEIFAHLGLDYVEPWERNA

SEQ ID NO: 1649 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataaccacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1650 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNHNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1651 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgataactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagaagatctttctgaaagcgggcagcgaagaagagattttcgcgcatctgggtctggattatgtggagccgtgggaacgcaacgcg

SEQ ID NO: 1652 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMADNYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKKIFLKAGSEEEIFAHLGLDYVEPWERNA

SEQ ID NO: 1653 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagaaaggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1654 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEEKGMILDNHGLYDRKKRIFLKAGSEEEIFAHLGLDYVEPWERNA

SEQ ID NO: 1655 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacgtcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1656 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDVDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1657 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctaaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcgaaaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1658 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLEKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1659 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccgaaaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1660 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKAEKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1661 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagatggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1662 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEDGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1663 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaaagtcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1664 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQSRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1665 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacgctggaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1666 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTLEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1667 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttactaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1668 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVTKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1669 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttaaggacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1670 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVKDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1671 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagacgcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1672 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEDAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1673 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagccgcatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1674 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSRMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1675 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgccgtaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgcgacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1676 - protein, 394 aa, synthetic construct
  REGION 1..394: note = Variant of terminal deoxynucleotidyl transferase
MHHHHHHGGSGHPPSNTPEGEVPSVIARKVSQYSCQRRTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1677 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1678 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHALYDRKKRIFLKAGSEEEIFAHLGLDYVEPWERNA

SEQ ID NO: 1679 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagccgaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagtgaagaagagattttcgcgcatctgggtctggattatgtggagccgtgggaacgcaacgcg

SEQ ID NO: 1680 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKAEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1681 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccactctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaacccgcaaaatcgacgccatggacaacttccagaagtgcttcgccattctcaagctgtaccagccgggcgtggataacagcagctataacacgagtaagaagagtgacatggccgaggtaaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1682 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKEEADAVTLIVKNTVRTFLPDALVTITGGFRRGKPMGHDIDFLITNPGPKEDDELLHKVVDLLKKQGLLLYEDIKESTFVEEQLPTRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1683 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagccgaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgtgacatcaaagagagcacgttcgtggaggaacaactgccaacccgcaaaatcgacgccatggacaacttccagaagtgcttcgccattctcaagctgtaccagccgggcgtggataacagcagctataacacgagtaagaagagtgacatggccgagaaaaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagtgaagaagagattttcgcgcatctgggtctggattatgtggagccgtgggaacgcaacgcg

SEQ ID NO: 1684 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYCDIKESTFVEEQLPTRKIDAMDNFQKCFAILKLYQPGVDNSSYNTSKKSDMAEKKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1685 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagccgcaaaatcgacgccatggacaacttccagaagtgcttcgccattctcaagctgtaccagccgggcgtggataacagcagctataacacgagtaagaagagtgacatggccgaggtaaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1686 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1687 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagagctacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtactgtgacatcaaagagagcacgttcgtggaggaacaactgccaacccgcaaaatcgacgccatggacaacttccagaagtgcttcgccattctcaagctgtaccagccgggcgtggataacagcagctataacacgagtaagaagagtgacatggccgaggtaaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagtgaagaagagattttcgcgcatctgggtctggattatgtggagccgtgggaacgcaacgcg

SEQ ID NO: 1688 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAESYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKEEADAVTLIVKNTVRTFLPDALVTITGGFRRGKPMGHDIDFLITNPGPKEDDELLHKVVDLLKKQGLLLYCDIKESTFVEEQLPTRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1689 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtggtgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagccgcaaaatcgacgccatggacaacttccagaagtgcttcgccattctcaagctgtaccagccgggcgtggataacagcagctataacacgagtaagaagagtgacatggccgagaaaaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1690 - protein, 394 aa, synthetic construct
  REGION 1..394: note = Variant of terminal deoxynucleotidyl transferase
MHHHHHHGGSGHPPSNTPEGEVVSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEKKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1691 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagcggaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagccgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatggcctctacgaccgcaaaaagcgcatctttctgaaagcgggcagcgaagaagagattttcgcgcatctgggtctggattatgtggagccgtgggaacgcaacgcg

SEQ ID NO: 1692 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKAEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHGLYDRKKRIFLKAGSEEEIFAHLGLDYVEPWERNA

SEQ ID NO: 1693 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttaagcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1694 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFKRDLRRYAEEERGMILDNHALYDRKKRIFLKAGSEEEIFAHLGLDYVEPWERNA

SEQ ID NO: 1695 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttgttcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1696 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFVRDLRRYAEEERGMILDNHALYDRKKRIFLKAGSEEEIFAHLGLDYVEPWERNA

SEQ ID NO: 1697 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttattcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1698 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFIRDLRRYAEEERGMILDNHALYDRKKRIFLKAGSEEEIFAHLGLDYVEPWERNA

SEQ ID NO: 1699 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1700 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1701 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcttcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1702 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFLRDLRRYAEEERGMILDNHALYDRKKRIFLKAGSEEEIFAHLGLDYVEPWERNA

SEQ ID NO: 1703 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttatgcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1704 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFMRDLRRYAEEERGMILDNHALYDRKKRIFLKAGSEEEIFAHLGLDYVEPWERNA

SEQ ID NO: 1705 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaattttgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1706 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFCRDLRRYAEEERGMILDNHALYDRKKRIFLKAGSEEEIFAHLGLDYVEPWERNA

SEQ ID NO: 1707 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttacgcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1708 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFTRDLRRYAEEERGMILDNHALYDRKKRIFLKAGSEEEIFAHLGLDYVEPWERNA

SEQ ID NO: 1709 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcatcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1710 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFHRDLRRYAEEERGMILDNHALYDRKKRIFLKAGSEEEIFAHLGLDYVEPWERNA

SEQ ID NO: 1711 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgaaagcggccatccgattagcaataccccggagggggaggtgccgagcgttatcgcccgcaaggttagtcagtacagctgccagcgcaagaccacgctgaataactacaacaaaaagtttaccgacgcgctggagatcatggccgagagttacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagaagaagccgatgtagttacgctcatcgtgaagggcacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagcgttaacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1712 - protein, 394 aa, synthetic construct
  REGION 1..394: note = Variant of terminal deoxynucleotidyl transferase
MHHHHHHGESGHPISNTPEGEVPSVIARKVSQYSCQRKTTLNNYNKKFTDALEIMAESYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKEEADVVTLIVKGTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSVNTSKKSDMAEVKDWKAIRVDLVITPFEQYAYALLGWTGSKEFGRDLRRYAEEERGMILDNHALYDRKKRIFLKAGSEEEIFAHLGLDYVEPWERNA

SEQ ID NO: 1713 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagagttacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagggcacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctacaacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 1714 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAESYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKGTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHALYDLKKRIFLKAGSEEEIFAHLGLDYVEPWERNA

SEQ ID NO: 1715 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgaaagcggccatccgattagcaataccccggagggggaggtgccgagcgttatcgcccgcaaggttagtcagtacagctgccagcgcaagaccacgctgaataactacaacaaaaagtttaccgacgcgctggagatcatggccgagaattacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgtagttacgctcatcgtgaagggcacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctacaacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 1716 - protein, 394 aa, synthetic construct
  REGION 1..394: note = Variant of terminal deoxynucleotidyl transferase
MHHHHHHGESGHPISNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADVVTLIVKGTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHALYDLKKRIFLKAGSEEEIFAHLGLDYVEPWERNA

SEQ ID NO: 1717 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggcagcggccatccgcctagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagggcacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagcgttaacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1718 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKGTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSVNTSKKSDMAEVKDWKAIRVDLVITPFEQYAYALLGWTGSKEFGRDLRRYAEEERGMILDNHALYDRKKRIFLKAGSEEEIFAHLGLDYVEPWERNA

SEQ ID NO: 1719 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgcctagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagaagaagccgatgccgttacgctcatcgtgaagggcacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctacaacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1720 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKEEADAVTLIVKGTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHALYDRKKRIFLKAGSEEEIFAHLGLDYVEPWERNA

SEQ ID NO: 1721 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggcagcggccatccgattagcaataccccggagggggaggtgccgagcgttatcgcccgcaaggttagtcagtacagctgccagcgcaagaccacgctgaataactacaacaaaaagtttaccgacgcgctggagatcatggccgagaattacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgtagttacgctcatcgtgaagggcacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagcgttaacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatgccctctacgaccgtaaaaagcgcatctttctgaaagcgggcagcgaagaagagattttcgcgcatctgggtctggattatgtggagccgtgggaacgcaacgcg

SEQ ID NO: 1722 - protein, 394 aa, synthetic construct
  REGION 1..394: note = Variant of terminal deoxynucleotidyl transferase
MHHHHHHGGSGHPISNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADVVTLIVKGTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSVNTSKKSDMAEVKDWKAIRVDLVITPFEQYAYALLGWTGSKEFGRDLRRYAEEERGMILDNHALYDRKKRIFLKAGSEEEIFAHLGLDYVEPWERNA

SEQ ID NO: 1723 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggcagcggccatccgcctagcaataccccggagggggaggtgccgagcgttatcgcccgcaaggttagtcagtacagctgccagcgcaagaccacgctgaataactacaacaaaaagtttaccgacgcgctggagatcatggccgagagttacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgcagttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctacaacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 1724 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAESYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHALYDLKKRIFLKAGSEEEIFAHLGLDYVEPWERNA

SEQ ID NO: 1725 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggcagcggccatccgattagcaataccccggagggggaggtgccgagcgttatcgcccgcaaggttagtcagtacagctgccagcgcaagaccacgctgaataactacaacaaaaagtttaccgacgcgctggagatcatggccgagaattacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagggcacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagcgttaacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 1726 - protein, 394 aa, synthetic construct
  REGION 1..394: note = Variant of terminal deoxynucleotidyl transferase
MHHHHHHGGSGHPISNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKGTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSVNTSKKSDMAEVKDWKAIRVDLVITPFEQYAYALLGWTGSKEFGRDLRRYAEEERGMILDNHALYDLKKRIFLKAGSEEEIFAHLGLDYVEPWERNA

SEQ ID NO: 1727 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggcagcggccatccgcctagcaataccccggagggggaggtgccgagcgttatcgcccgcaaggttagtcagtacagctgccagcgcaagaccacgctgaataactacaacaaaaagtttaccgacgcgctggagatcatggccgagagttacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagggcacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatgccctctacgaccgtaaaaagcgcatctttctgaaagcgggcagcgaagaagagattttcgcgcatctgggtctggattatgtggagccgtgggaacgcaacgcg

SEQ ID NO: 1728 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAESYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKGTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHALYDRKKRIFLKAGSEEEIFAHLGLDYVEPWERNA

SEQ ID NO: 1729 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgattagcaataccccggagggggaggtgccgagcgttatcgcccgcaaggttagtcagtacagctgccagcgcaagaccacgctgaataactacaacaaaaagtttaccgacgcgctggagatcatggccgagagttacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctacaacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1730 - protein, 394 aa, synthetic construct
  REGION 1..394: note = Variant of terminal deoxynucleotidyl transferase
MHHHHHHGDSGHPISNTPEGEVPSVIARKVSQYSCQRKTTLNNYNKKFTDALEIMAESYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHALYDRKKRIFLKAGSEEEIFAHLGLDYVEPWERNA

SEQ ID NO: 1731 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggcagcggccatccgcctagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctacaacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatgccctctacgaccgtaaaaagcgcatctttctgaaagcgggcagcgaagaagagattttcgcgcatctgggtctggattatgtggagccgtgggaacgcaacgcg

SEQ ID NO: 1732 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHALYDRKKRIFLKAGSEEEIFAHLGLDYVEPWERNA

SEQ ID NO: 1733 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggcagcggccatccgattagcaataccccggagggggaggtgccgagcgttatcgcccgcaaggttagtcagtacagctgccagcgcaagaccacgctgaataactacaacaaaaagtttaccgacgcgctggagatcatggccgagaattacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagcgttaacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatgccctctacgactttaaaaagcgcatctttctgaaagcgggcagcgaagaagagattttcgcgcatctgggtctggattatgtggagccgtgggaacgcaacgcg

SEQ ID NO: 1734 - protein, 394 aa, synthetic construct
  REGION 1..394: note = Variant of terminal deoxynucleotidyl transferase
MHHHHHHGGSGHPISNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSVNTSKKSDMAEVKDWKAIRVDLVITPFEQYAYALLGWTGSKEFGRDLRRYAEEERGMILDNHALYDFKKRIFLKAGSEEEIFAHLGLDYVEPWERNA

SEQ ID NO: 1735 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggcagcggccatccgattagcaataccccggagggggaggtgccgagcgttatcgcccgcaaggttagtcagtacagctgccagcgcaagaccacgctgaataactacaacaaaaagtttaccgacgcgctggagatcatggccgagagttacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagaagaagccgatgcagttacgctcatcgtgaagggcacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagcgttaacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 1736 - protein, 394 aa, synthetic construct
  REGION 1..394: note = Variant of terminal deoxynucleotidyl transferase
MHHHHHHGGSGHPISNTPEGEVPSVIARKVSQYSCQRKTTLNNYNKKFTDALEIMAESYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKEEADAVTLIVKGTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSVNTSKKSDMAEVKDWKAIRVDLVITPFEQYAYALLGWTGSKEFGRDLRRYAEEERGMILDNHALYDLKKRIFLKAGSEEEIFAHLGLDYVEPWERNA

SEQ ID NO: 1737 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgcctagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagcgttaacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1738 - protein, 394 aa, synthetic construct
  REGION 1..394: note = Variant of terminal deoxynucleotidyl transferase
MHHHHHHGDSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSVNTSKKSDMAEVKDWKAIRVDLVITPFEQYAYALLGWTGSKEFGRDLRRYAEEERGMILDNHALYDRKKRIFLKAGSEEEIFAHLGLDYVEPWERNA

SEQ ID NO: 1739 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggcagcggccatccgcctagcaataccccggagggggaggtgccgagcgttatcgcccgcaaggttagtcagtacagctgccagcgcaagaccacgctgaataactacaacaaaaagtttaccgacgcgctggagatcatggccgagaattacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgcgttagtaaagaagaagccgatgcagttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagcgttaacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 1740 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASCVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSVNTSKKSDMAEVKDWKAIRVDLVITPFEQYAYALLGWTGSKEFGRDLRRYAEEERGMILDNHALYDLKKRIFLKAGSEEEIFAHLGLDYVEPWERNA

SEQ ID NO: 1741 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgaaagcggccatccgcctagcaataccccggagggggaggtgccgagcgttatcgcccgcaaggttagtcagtacagctgccagcgcaagaccacgctgaataactacaacaaaaagtttaccgacgcgctggagatcatggccgagagttacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgcagttacgctcatcgtgaagggcacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctacaacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1742 - protein, 394 aa, synthetic construct
  REGION 1..394: note = Variant of terminal deoxynucleotidyl transferase
MHHHHHHGESGHPPSNTPEGEVPSVIARKVSQYSCQRKTTLNNYNKKFTDALEIMAESYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKGTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHALYDRKKRIFLKAGSEEEIFAHLGLDYVEPWERNA

SEQ ID NO: 1743 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggcatcggccatccgattagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgcagttacgctcatcgtgaagggcacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctacaacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 1744 - protein, 394 aa, synthetic construct
  REGION 1..394: note = Variant of terminal deoxynucleotidyl transferase
MHHHHHHGGIGHPISNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKGTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFGRDLRRYAEEERGMILDNHALYDLKKRIFLKAGSEEEIFAHLGLDYVEPWERNA

SEQ ID NO: 1745 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagcgttaacacgagtaagaagagtgacatggccgaggttaaggattggaaagcgattcgtgtggatctggtgatcacgccattcgagcagtacgcctatgcgctgctcggttggacgggcagcaaagaatttggtcgcgatctgcgccgctatgcggaggaagagcgcggcatgatcctcgacaaccatgccctctacgaccgtaaaaagcgcatctttctgaaagcgggcagcgaagaagagattttcgcgcatctgggtctggattatgtggagccgtgggaacgcaacgcg

SEQ ID NO: 1746 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSVNTSKKSDMAEVKDWKAIRVDLVITPFEQYAYALLGWTGSKEFGRDLRRYAEEERGMILDNHALYDRKKRIFLKAGSEEEIFAHLGLDYVEPWERNA

SEQ ID NO: 1747 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcaaaggccagtaagagtctgaagctgagcaagatgcagaaggcgggcttcctgtattacgaggatctggcgagccgcgttagtcgtgaagaagccgatgccgttacgagcatcgtgaagaatacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1748 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTAEKWFRMGLRTVEEAKASKSLKLSKMQKAGFLYYEDLASRVSREEADAVTSIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1749 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1750 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1751 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggtgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcaaaggccagtaagagtctgaagctgagcaagatgcagaaggcgggcttcctgtattacgaggatctggcgagccgcgttagtaaggaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacaatgcgtataatacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1752 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNNAYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1753 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaacctcggaaaagtggtttcgtatgggcctccgtacggttgaagaggcaaaggccagtaagagtctgaagctgagcaagatgcagaaggcgggcttcctgtattacgaggatctggcgagccgcgttagtcgtgaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacaattcgtatgggacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1754 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTSEKWFRMGLRTVEEAKASKSLKLSKMQKAGFLYYEDLASRVSREEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNNSYGTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1755 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcaaaggccagtaaggcgctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1756 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKALKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1757 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcaaaggccagtaagagtctgaagctgagcaagatgcagaaggcgggcttcctgtattacgaggatctggcgagccgcgttagtcgtgaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1758 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSREEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1759 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaacctcggaaaagtggtttcgtatgggcctccgtacggttgaagaggcaaaggccagtaagagtctgaagctgagcaagatgcagcgtgcgggcttcctgtattacgaggatctggcgagccgcgttagtcgtgaagaagccgatgccgttacgagcatcgtgaagaatacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagttcgtatgggacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1760 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQRAGFLYYEDLASRVSREEADAVTSIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYGTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1761 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcacgtgccagtaagtcgctgaagctgagcaagatgcagaaggcgggcttcctgtattacgaggatctggcgagccgcgttagtaaagaagaagccgatgccgttacgctgatcgtgaaggaaacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1762 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTAEKWFRMGLRTVEEARASKSLKLSKMQKAGFLYYEDLASRVSKEEADAVTLIVKETVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1763 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggtgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaacctcggaaaagtggtttcgtatgggcctccgtacggttgaagaggcacgtgccagtaagtcgctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1764 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEARASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1765 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggtgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcaaaggccagtaagagtctgaagctgagcaagatgcagcgtgcgggcttcctgtattacgaggatctggcgagccgcgttagtaaagaagaagccgatgccgttacgagcatcgtgaaggaaacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1766 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTAEKWFRMGLRTVEEAKASKSLKLSKMQRAGFLYYEDLASRVSKEEADAVTSIVKETVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1767 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagcggtgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1768 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASGVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1769 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattgctgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaacctcggaaaagtggtttcgtatgggcctccgtacggttgaagaggcaaaggccagtaagagtctgaagctgagcaagatgcagaaggcgggcttcctgtattacgaggatctggcgagccgcgttagtcgtgaagaagccgatgccgttacgagcatcgtgaaggaaacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcgtataatacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1770 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIADQVRDVIEEIIEEGESSRVKEVLNDERYKAFKQFTSVFGVGVKTSEKWFRMGLRTVEEAKASKSLKLSKMQKAGFLYYEDLASRVSREEADAVTSIVKETVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSAYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1771 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattgctgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagtcgctgaagctgagcaagatgcagaaggcgggcttcctgtattacgaggatctggcgagccgcgttagtcgtgaagaagccgatgccgttacgctcatcgtgaaggaaacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1772 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFPVTSMKDIQGLPCIADQVRDVIEEIIEEGESSRVKEVLNDERYKAFKQFTSVFGVGVKTSEKWFRMGLRTVEEAKASKSLKLSKMQKAGFLYYEDLASRVSREEADAVTLIVKETVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1773 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcaaaggccagtaagagtctgaagctgagcaagatgcagaaggcgggcttcctgtattacgaggatctggcgagccgcgttagtaaggaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggagcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1774 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1775 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaggaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggagcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1776 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1777 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgccgggaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatcgagggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtaccgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgattgatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccgcccgggcgtggataacagcagctataacacgagtaagggcagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1778 - protein, 394 aa, synthetic construct
  REGION 1..394: note = Variant of terminal deoxynucleotidyl transferase
MHHHHHHGGSGHPPSNTPEGEVPSVIAGKVSQYSCQRKTTLNNYNKKFTDALEIMAENYKFKENLIACLEAKRAASILKYLPFPVTSMKDIEGLPCIGDQVRDVIEEIIEEGESSRVKEVLNDERYKAFKQFTSVFGVGVKTSEKWYRMGLRTVEEAKASKSLKLSKMQKAGFLYYEDLASRVSKEEADAVTLIVKNTVRTFLIDALVTITGGFRRGKPMGHDIDFLITNPGPKEDDELLHKVVDLLKKQGLLLYEDIKESTFVEEQLPSRKIDAMDNFQKCFAILKLYRPGVDNSSYNTSKGSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1779 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1780 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1781 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgccgggaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatcgagggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggttccgtatgggcctccgtacggttgaagacgcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgctggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccgcccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1782 - protein, 394 aa, synthetic construct
  REGION 1..394: note = Variant of terminal deoxynucleotidyl transferase
MHHHHHHGGSGHPPSNTPEGEVPSVIAGKVSQYSCQRKTTLNNYNKKFTDALEIMAENYKFKENLIACLEAKRAASILKYLPFPVTSMKDIEGLPCIGDQVRDVIEEIIEEGESSRVKEVLNDERYKAFKQFTSVFGVGVKTSEKWFRMGLRTVEDAKASKSLKLSKMQKAGFLYYEDLASRVSKEEADAVTLIVKNTVRTFLLDALVTITGGFRRGKPMGHDIDFLITNPGPKEDDELLHKVVDLLKKQGLLLYEDIKESTFVEEQLPSRKIDAMDNFQKCFAILKLYRPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1783 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgccgagaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccagggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggttccgtatgggcctccgtacggttgaagacgcaaaggccagtaagagtctgaagctgagcaagatgcagaaggcgggcctgctgtattacgaggatctggcgagccgcgttagtaaagaagaagccgatgccgttacgctcatcgtgaagaacacggtgcgtacctttctgatggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccgcccgggcgtggataacagcagctataacacgagtaagggcagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1784 - protein, 394 aa, synthetic construct
  REGION 1..394: note = Variant of terminal deoxynucleotidyl transferase
MHHHHHHGGSGHPPSNTPEGEVPSVIAEKVSQYSCQRKTTLNNYNKKFTDALEIMAENYKFKENLIACLEAKRAASILKYLPFEVTSMKDIQGLPCIGDQVRDVIEEIIEEGESSRVKEVLNDERYKAFKQFTSVFGVGVKTSEKWFRMGLRTVEDAKASKSLKLSKMQKAGLLYYEDLASRVSKEEADAVTLIVKNTVRTFLMDALVTITGGFRRGKPMGHDIDFLITNPGPKEDDELLHKVVDLLKKQGLLLYEDIKESTFVEEQLPSRKIDAMDNFQKCFAILKLYRPGVDNSSYNTSKGSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1785 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtaccgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccgcccgggcgtggataacagcagctataacacgagtaagacgagtgacatggtcgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1786 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWYRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYRPGVDNSSYNTSKTSDMVEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1787 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggtgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagcgtgcgggcttcctgtattacgaggatctggcgagccgcgttagtaaagaagaagccgatgccgttacgagcatcgtgaaggaaacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagttcgtataatacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1788 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQRAGFLYYEDLASRVSKEEADAVTSIVKETVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1789 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattgctgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaacctcggaaaagtggtttcgtatgggcctccgtacggttgaagaggcaaaggccagtaagagtctgaagctgagcaagatgcagaaggcgggcttcctgtattacgaggatctggcgagccgcgttagtcgtgaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggagcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1790 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIADQVRDVIEEIIEEGESSRVKEVLNDERYKAFKQFTSVFGVGVKTSEKWFRMGLRTVEEAKASKSLKLSKMQKAGFLYYEDLASRVSREEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1791 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgccgggaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccagggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggttccgtatgggcctccgtacggttgaagaagcaaaggccagtaagagtctgaagctgagcaagatgcagaaggcgggcctgctgtattacgaggatctggcgagccgcgttagtaaagaagaagccgatgccgttacgctcatcgtgaagaacacggtgcgtacctttctgcgtgatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagacgagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1792 - protein, 394 aa, synthetic construct
  REGION 1..394: note = Variant of terminal deoxynucleotidyl transferase
MHHHHHHGGSGHPPSNTPEGEVPSVIAGKVSQYSCQRKTTLNNYNKKFTDALEIMAENYKFKENLIACLEAKRAASILKYLPFEVTSMKDIQGLPCIGDQVRDVIEEIIEEGESSRVKEVLNDERYKAFKQFTSVFGVGVKTSEKWFRMGLRTVEEAKASKSLKLSKMQKAGLLYYEDLASRVSKEEADAVTLIVKNTVRTFLRDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKTSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1793 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggtgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcaaaggccagtaaggcgctgaagctgagcaagatgcagaaggcgggcttcctgtattacgaggatctggcgagccgcgttagtaaggaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1794 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTAEKWFRMGLRTVEEAKASKALKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1795 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccagggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcctgctgtattacgaggatctggcgagccgcgttagtaaagaagaagccgatgccgttacgctcatcgtgaagaacacggtgcgtacctttctgtttgatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagacgagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1796 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFEVTSMKDIQGLPCIGDQVRDVIEEIIEEGESSRVKEVLNDERYKAFKQFTSVFGVGVKTSEKWFRMGLRTVEEAKASKSLKLSKMQKAGLLYYEDLASRVSKEEADAVTLIVKNTVRTFLFDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKTSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1797 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgccgagaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccagggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgcctgatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccgcccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1798 - protein, 394 aa, synthetic construct
  REGION 1..394: note = Variant of terminal deoxynucleotidyl transferase
MHHHHHHGGSGHPPSNTPEGEVPSVIAEKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYRPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1799 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatcgagggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggttccgtatgggcctccgtacggttgaagaagcaaaggccagtaagagtctgaagctgagcaagatgcagaaggcgggcctgctgtattacgaggatctggcgagccgcgttagtaaagaagaagccgatgccgttacgctcatcgtgaagaacacggtgcgtacctttctgtttgatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtacgtaccgggcgtggataacagcagctataacacgagtaagggcagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1800 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIEGLPCIGDQVRDVIEEIIEEGESSRVKEVLNDERYKAFKQFTSVFGVGVKTSEKWFRMGLRTVEEAKASKSLKLSKMQKAGLLYYEDLASRVSKEEADAVTLIVKNTVRTFLFDALVTITGGFRRGKPMGHDIDFLITNPGPKEDDELLHKVVDLLKKQGLLLYEDIKESTFVEEQLPSRKIDAMDNFQKCFAILKLYVPGVDNSSYNTSKGSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1801 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgccgagaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatcgagggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtaccgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgcgtgatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1802 - protein, 394 aa, synthetic construct
  REGION 1..394: note = Variant of terminal deoxynucleotidyl transferase
MHHHHHHGGSGHPPSNTPEGEVPSVIAEKVSQYSCQRKTTLNNYNKKFTDALEIMAENYKFKENLIACLEAKRAASILKYLPFEVTSMKDIEGLPCIGDQVRDVIEEIIEEGESSRVKEVLNDERYKAFKQFTSVFGVGVKTSEKWYRMGLRTVEEAKASKSLKLSKMQKAGFLYYEDLASRVSKEEADAVTLIVKNTVRTFLRDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1803 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgccgagaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatcgagggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtaccgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1804 - protein, 394 aa, synthetic construct
  REGION 1..394: note = Variant of terminal deoxynucleotidyl transferase
MHHHHHHGGSGHPPSNTPEGEVPSVIAEKVSQYSCQRKTTLNNYNKKFTDALEIMAENYKFKENLIACLEAKRAASILKYLPFPVTSMKDIEGLPCIGDQVRDVIEEIIEEGESSRVKEVLNDERYKAFKQFTSVFGVGVKTSEKWYRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1805 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcgtatgggacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1806 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSAYGTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1807 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgccgggaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatcgagggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggttccgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgcgtgatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1808 - protein, 394 aa, synthetic construct
  REGION 1..394: note = Variant of terminal deoxynucleotidyl transferase
MHHHHHHGGSGHPPSNTPEGEVPSVIAGKVSQYSCQRKTTLNNYNKKFTDALEIMAENYKFKENLIACLEAKRAASILKYLPFPVTSMKDIEGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLRDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1809 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgccgggaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccagggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggttccgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgcgtgatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1810 - protein, 394 aa, synthetic construct
  REGION 1..394: note = Variant of terminal deoxynucleotidyl transferase
MHHHHHHGGSGHPPSNTPEGEVPSVIAGKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLRDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1811 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgccgagaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggttccgtatgggcctccgtacggttgaagaggcaaaggccagtaagagtctgaagctgagcaagatgcagaaggcgggcctgctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagggcagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1812 - protein, 394 aa, synthetic construct
  REGION 1..394: note = Variant of terminal deoxynucleotidyl transferase
MHHHHHHGGSGHPPSNTPEGEVPSVIAEKVSQYSCQRKTTLNNYNKKFTDALEIMAENYKFKENLIACLEAKRAASILKYLPFEVTSMKDIQGLPCIGDQVRDVIEEIIEEGESSRVKEVLNDERYKAFKQFTSVFGVGVKTSEKWFRMGLRTVEEAKASKSLKLSKMQKAGLLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKGSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1813 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccagggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggttccgtatgggcctccgtacggttgaagaggcaaaggccagtaagagtctgaagctgagcaagatgcagaaggcgggcctgctgtattacgaggatctggcgagccgcgttagtaaagaagaagccgatgccgttacgctcatcgtgaagaacacggtgcgtacctttctgtttgatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagggcagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1814 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGLLYYEDLASRVSKEEADAVTLIVKNTVRTFLFDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKGSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1815 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgccgggaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagggcagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1816 - protein, 394 aa, synthetic construct
  REGION 1..394: note = Variant of terminal deoxynucleotidyl transferase
MHHHHHHGGSGHPPSNTPEGEVPSVIAGKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKGSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1817 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgccgggaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccagggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtaccgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagggcagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1818 - protein, 394 aa, synthetic construct
  REGION 1..394: note = Variant of terminal deoxynucleotidyl transferase
MHHHHHHGGSGHPPSNTPEGEVPSVIAGKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWYRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKGSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1819 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcctgctgtattacgaggatctggcgagccgcgttagtaaagaagaagccgatgccgttacgctcatcgtgaagaacacggtgcgtacctttctgcgtgatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1820 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGLLYYEDLASRVSKEEADAVTLIVKNTVRTFLRDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1821 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatcgagggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggttccgtatgggcctccgtacggttgaagaggcaaaggccagtaagagtctgaagctgagcaagatgcagaaggcgggcctgctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1822 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFEVTSMKDIEGLPCIGDQVRDVIEEIIEEGESSRVKEVLNDERYKAFKQFTSVFGVGVKTSEKWFRMGLRTVEEAKASKSLKLSKMQKAGLLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1823 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaacctcggaaaagtggtttcgtatgggcctccgtacggttgaagaggcaaaggccagtaaggcgctgaagctgagcaagatgcagaaggcgggcttcctgtattacgaggatctggcgagccgcgttagtaaagaagaagccgatgccgttacggtgatcgtgaagaatacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1824 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTSEKWFRMGLRTVEEAKASKALKLSKMQKAGFLYYEDLASRVSKEEADAVTVIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1825 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcacgtgccagtaagtcgctgaagctgagcaagatgcagcgtgcgggcttcctgtattacgaggatctggcgagccgcgttagtcgtgaagaagccgatgccgttacgctgatcgtgaagaatacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggagcaactgccaagtcgcaaaatcgacgccatggacaacttccagaagtgcttcgccattctcaagctgtaccagccgggcgtggataacaatgcgtataatacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1826 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEARASKSLKLSKMQRAGFLYYEDLASRVSREEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNNAYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1827 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaatacccaggagggggaggtgccgagcgttatcgccgggaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccagggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtaccgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgcctgatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagggcagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1828 - protein, 394 aa, synthetic construct
  REGION 1..394: note = Variant of terminal deoxynucleotidyl transferase
MHHHHHHGGSGHPPSNTQEGEVPSVIAGKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWYRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKGSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1829 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaggcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1830 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEARRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1831 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggtgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaacctcggaaaagtggtttcgtatgggcctccgtacggttgaagaggcaaaggccagtaagagtctgaagctgagcaagatgcagaaggcgggcttcctgtattacgaggatctggcgagccgcgttagtcgtgaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacaattcgtataatacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1832 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSREEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNNSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1833 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaagcaaaggccagtaagagtctgaagctgagcaagatgcagaaggcgggcctgctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1834 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGLLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1835 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgccgagaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggttccgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1836 - protein, 394 aa, synthetic construct
  REGION 1..394: note = Variant of terminal deoxynucleotidyl transferase
MHHHHHHGGSGHPPSNTPEGEVPSVIAEKVSQYSCQRKTTLNNYNKKFTDALEIMAENYKFKENLIACLEAKRAASILKYLPFEVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1837 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaacctcggaaaagtggtttcgtatgggcctccgtacggttgaagaggcaaaggccagtaagtcgctgaagctgagcaagatgcagcgtgcgggcttcctgtattacgaggatctggcgagccgcgttagtaaggaagaagccgatgccgttacgagcatcgtgaaggaaacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggagcaactgccaagtcgcaaaatcgacgccatggacaacttccagaagtgcttcgccattctcaagctgtaccagccgggcgtggataacagttcgtataatacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1838 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTSEKWFRMGLRTVEEAKASKSLKLSKMQRAGFLYYEDLASRVSKEEADAVTSIVKETVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1839 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgccgggaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggttccgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagggcagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1840 - protein, 394 aa, synthetic construct
  REGION 1..394: note = Variant of terminal deoxynucleotidyl transferase
MHHHHHHGGSGHPPSNTPEGEVPSVIAGKVSQYSCQRKTTLNNYNKKFTDALEIMAENYKFKENLIACLEAKRAASILKYLPFEVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKGSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1841 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1842 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFEVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1843 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgccgggaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1844 - protein, 394 aa, synthetic construct
  REGION 1..394: note = Variant of terminal deoxynucleotidyl transferase
MHHHHHHGGSGHPPSNTPEGEVPSVIAGKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1845 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagggcagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1846 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKGSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1847 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgcgtgatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1848 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLRDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1849 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccagggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggttccgtatgggcctccgtacggttgaagacgcaaaggccagtaagagtctgaagctgagcaagatgcagaaggcgggcctgctgtattacgaggatctggcgagccgcgttagtaaagaagaagccgatgccgttacgctcatcgtgaagaacacggtgcgtacctttctgtttgatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1850 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFEVTSMKDIQGLPCIGDQVRDVIEEIIEEGESSRVKEVLNDERYKAFKQFTSVFGVGVKTSEKWFRMGLRTVEDAKASKSLKLSKMQKAGLLYYEDLASRVSKEEADAVTLIVKNTVRTFLFDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1851 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgccgggaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccagggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagacgcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgattgatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1852 - protein, 394 aa, synthetic construct
  REGION 1..394: note = Variant of terminal deoxynucleotidyl transferase
MHHHHHHGGSGHPPSNTPEGEVPSVIAGKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEDAKASKSLKLSKMQKAGFLYYEDLASRVSKEEADAVTLIVKNTVRTFLIDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1853 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgccgggaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccagggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtaccgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgctggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1854 - protein, 394 aa, synthetic construct
  REGION 1..394: note = Variant of terminal deoxynucleotidyl transferase
MHHHHHHGGSGHPPSNTPEGEVPSVIAGKVSQYSCQRKTTLNNYNKKFTDALEIMAENYKFKENLIACLEAKRAASILKYLPFEVTSMKDIQGLPCIGDQVRDVIEEIIEEGESSRVKEVLNDERYKAFKQFTSVFGVGVKTSEKWYRMGLRTVEEAKASKSLKLSKMQKAGFLYYEDLASRVSKEEADAVTLIVKNTVRTFLLDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1855 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggtgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagtcgctgaagctgagcaagatgcagaaggcgggcttcctgtattacgaggatctggcgagccgcgttagtaaggaagaagccgatgccgttacggtgatcgtgaaggaaacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggagcaactgccaagtcgcaaaatcgacgccatggacaacttccagaagtgcttcgccattctcaagctgtaccagccgggcgtggataacaatgcgtataatacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1856 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTVIVKETVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNNAYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1857 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaggaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1858 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1859 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggtgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaacctcggaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1860 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1861 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagcccagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1862 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAQRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1863 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgaagcgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1864 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLKRYAEEERGMILDNHALYDRKKRIFLKAGSEEEIFAHLGLDYVEPWERNA

SEQ ID NO: 1865 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgtggactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1866 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1867 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagcaatgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1868 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASNVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1869 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1870 - protein, 394 aa, synthetic construct; identical to SEQ ID NO: 1776
  REGION 1..394: note = Variant of terminal deoxynucleotidyl transferase

SEQ ID NO: 1871 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagcctctcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1872 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEASRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1873 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctgggttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1874 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASWVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1875 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccaggttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1876 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASQVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1877 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctatgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1878 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASYVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1879 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccgggcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1880 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAGRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1881 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcggggaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1882 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSGEFRRDLRRYAEEERGMILDNHALYDRKKRIFLKAGSEEEIFAHLGLDYVEPWERNA

SEQ ID NO: 1883 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgattcgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1884 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLIRYAEEERGMILDNHALYDRKKRIFLKAGSEEEIFAHLGLDYVEPWERNA

SEQ ID NO: 1885 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacacgtttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1886 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYTFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1887 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagctttgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1888 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASFVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1889 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacactgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1890 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDTDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1891 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcgctgaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1892 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSAEFRRDLRRYAEEERGMILDNHALYDRKKRIFLKAGSEEEIFAHLGLDYVEPWERNA

SEQ ID NO: 1893 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1894 - protein, 394 aa, synthetic construct; identical to SEQ ID NO: 1842
  REGION 1..394: note = Variant of terminal deoxynucleotidyl transferase

SEQ ID NO: 1895 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagcagtgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1896 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASSVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1897 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagcgcggttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1898 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASAVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1899 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgctgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1900 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDADFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1901 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcgtgggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1902 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTIVGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1903 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcgcgggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1904 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTIAGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1905 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtaccgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1906 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWYRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1907 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggttccgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccgcccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1908 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYRPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1909 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagcctggcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1910 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAWRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1911 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaaccttatggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1912 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPYGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1913 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctttgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1914 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPLGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1915 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaaccttcgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1916 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPSGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1917 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctgtgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1918 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPVGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1919 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtgctgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1920 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRADLRRYAEEERGMILDNHALYDRKKRIFLKAGSEEEIFAHLGLDYVEPWERNA

SEQ ID NO: 1921 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgactgtgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1922 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDCDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1923 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccgagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1924 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAERAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1925 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcaaggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattggcgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccagcgaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggaacaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaatgttttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1926 - protein, 394 aa, synthetic construct
  REGION 1..394: note = Variant of terminal deoxynucleotidyl transferase
MHHHHHHGGSGHPPSNTPEGEVPSVIARKVSQYSCQRKTTLNNYNKKFTDALEIMAENYKFKENLIACLEAKRAASILKYLPFPVTSMKDIQGLPCIGDQVRDVIEEIIEEGESSRVKEVLNDERYKAFKQFTSVFGVGVKTSEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEEQLPSRKIDAMDNFQKCFAILKLYQPGVDNSSYNTSKKSDMAEVKDWKAIRVDLVITPFEQYAYALLGWTGSKCFRRDLRRYAEEERGMILDNHALYDRKKRIFLKAGSEEEIFAHLGLDYVEPWERNA

SEQ ID NO: 1927 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgctgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 1928 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 1929 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagacgcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 1930 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEDAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 1931 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 1932 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 1933 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagacgcacgtgccagtaagagtctgaagctgagcaagatgcagaaggcgggcttcctgtattacgaggatctggcgagccgcgttagtaaagaagaagccgatgttgttacggtcatcgtgaagaatacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 1934 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEDARASKSLKLSKMQKAGFLYYEDLASRVSKEEADVVTVIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 1935 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgccgagccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccgtccgggcgtggataacagcagctataacacgagtaagggtagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 1936 - protein, 394 aa, synthetic construct
  REGION 1..394: note = Variant of terminal deoxynucleotidyl transferase
MHHHHHHGDSGHPPSNTPEGEVPSVIAEPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYRPGVDNSSYNTSKGSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 1937 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccgtccgggcgtggataacagcagctataacacgagtaagggtagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 1938 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYRPGVDNSSYNTSKGSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 1939 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagacgcacgtgccagtaagagtctgaagctgagcaagatgcagaaggcgggctttctgtattacgaggatctggcgagccgcgttagtaaagaagaagccgatgctgttacggtcatcgtgaagaatacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccgtccgggcgtggataacagcagctataacacgagtaagggtagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 1940 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEDARASKSLKLSKMQKAGFLYYEDLASRVSKEEADAVTVIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYRPGVDNSSYNTSKGSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 1941 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgccgggccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 1942 - protein, 394 aa, synthetic construct
  REGION 1..394: note = Variant of terminal deoxynucleotidyl transferase
MHHHHHHGGSGHPPSNTPEGEVPSVIAGPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 1943 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccgtccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 1944 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYRPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 1945 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1946 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1947 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgccgggccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagacgcacgtgccagtaagagtctgaagctgagcaagatgcagaaggcgggcctgctgtattacgaggatctggcgagccgcgttagtaaagaagaagccgatgttgttacgtcgatcgtgaagaatacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagggtagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 1948 - protein, 394 aa, synthetic construct
  REGION 1..394: note = Variant of terminal deoxynucleotidyl transferase
MHHHHHHGDSGHPPSNTPEGEVPSVIAGPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEDARASKSLKLSKMQKAGLLYYEDLASRVSKEEADVVTSIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKGSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 1949 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgattagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacaactcgtatgggacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1950 - protein, 394 aa, synthetic construct
  REGION 1..394: note = Variant of terminal deoxynucleotidyl transferase
MHHHHHHGGSGHPISNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNNSYGTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1951 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgattagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaggcaaaggccagtaaggcgctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcgcgtatgggacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1952 - protein, 394 aa, synthetic construct
  REGION 1..394: note = Variant of terminal deoxynucleotidyl transferase
MHHHHHHGGSGHPISNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKALKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAYGTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1953 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgccgagccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagacgcacgtgccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccgtccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 1954 - protein, 394 aa, synthetic construct
  REGION 1..394: note = Variant of terminal deoxynucleotidyl transferase
MHHHHHHGDSGHPPSNTPEGEVPSVIAEPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEDARASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYRPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 1955 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgattagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaggcaaaggccagtaagtcgctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacaactcggtgaacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1956 - protein, 394 aa, synthetic construct
  REGION 1..394: note = Variant of terminal deoxynucleotidyl transferase
MHHHHHHGGSGHPISNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNNSVNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1957 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaggcaaaggccagtaagtcgctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcgcggtgaacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1958 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1959 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagagctacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaggcaaaggccagtaaggcgctgaagctgagcaagatgcagaaggcgggcttcctgtattacgaggatctggcgagccgcgttagtaaagaagaagccgatgccgttacgctcatcgtgaaggagacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacaacgcggtggggacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1960 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAESYKFKENLIACLEAKRAASILKYLPFPVTSMKDIQGLPCITDQVRDVIEEIIEEGESSRVKEVLNDERYKAFKQFTSVFGVGVKTAEKWYRMGLRTVEEAKASKALKLSKMQKAGFLYYEDLASRVSKEEADAVTLIVKETVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNNAVGTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1961 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgtcgagcgttatcgccgagccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagacgcacgtgccagtaagagtctgaagctgagcaagatgcagaaggcgggctttctgtattacgaggatctggcgagccgcgttagtaaagaagaagccgatgttgttacgtcgatcgtgaagaatacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccgtccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 1962 - protein, 394 aa, synthetic construct
  REGION 1..394: note = Variant of terminal deoxynucleotidyl transferase
MHHHHHHGGSGHPPSNTPEGEVSSVIAEPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEDARASKSLKLSKMQKAGFLYYEDLASRVSKEEADVVTSIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYRPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 1963 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacaactcggtgaacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1964 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNNSVNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1965 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagagctacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaggcaaaggccagtaagtcgctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagctcgtatgggacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1966 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAESYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSSYGTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1967 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgattagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaggcaaaggccagtaaggcgctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagctcggtggggacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1968 - protein, 394 aa, synthetic construct
  REGION 1..394: note = Variant of terminal deoxynucleotidyl transferase
MHHHHHHGGSGHPISNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKALKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSSVGTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1969 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgattagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaggcaaaggccagtaagtcgctgaagctgagcaagatgcagaaggcgggcttcctgtattacgaggatctggcgagccgcgttagtaaagaagaagccgatgccgttacgagcatcgtgaaggagacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacaactcgtataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1970 - protein, 394 aa, synthetic construct
  REGION 1..394: note = Variant of terminal deoxynucleotidyl transferase
MHHHHHHGGSGHPISNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASRVSKEEADAVTSIVKETVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNNSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1971 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgattagcaataccccggagggggaggtgccgagcgttatcgcccgcccggttagtcagtacagctgccagcgcaagaccacgctgaataactacaacaaaaagtttaccgacgcgctggagatcatggccgagagctacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaggcaaaggccagtaaggcgctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacaacgcggtggggacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1972 - protein, 394 aa, synthetic construct
  REGION 1..394: note = Variant of terminal deoxynucleotidyl transferase
MHHHHHHGGSGHPISNTPEGEVPSVIARPVSQYSCQRKTTLNNYNKKFTDALEIMAESYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKALKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNNAVGTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1973 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgccgggccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagacgcaaaggccagtaagagtctgaagctgagcaagatgcagaaggcgggcctgctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 1974 - protein, 394 aa, synthetic construct
  REGION 1..394: note = Variant of terminal deoxynucleotidyl transferase
MHHHHHHGGSGHPPSNTPEGEVPSVIAGPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEDAKASKSLKLSKMQKAGLLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 1975 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgccgagccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgttgttacgtcgatcgtgaagaatacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagggtagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 1976 - protein, 394 aa, synthetic construct
  REGION 1..394: note = Variant of terminal deoxynucleotidyl transferase
MHHHHHHGDSGHPPSNTPEGEVPSVIAEPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADVVTSIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKGSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 1977 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagagctacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaggcaaaggccagtaaggcgctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacaactcggtgaacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1978 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAESYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKALKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNNSVNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1979 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgattagcaataccccggagggggaggtgccgagcgttatcgcccgcccggttagtcagtacagctgccagcgcaagaccacgctgaataactacaacaaaaagtttaccgacgcgctggagatcatggccgagagctacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaggcaaaggccagtaaggcgctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacaacgcgtatgggacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1980 - protein, 394 aa, synthetic construct
  REGION 1..394: note = Variant of terminal deoxynucleotidyl transferase
MHHHHHHGGSGHPISNTPEGEVPSVIARPVSQYSCQRKTTLNNYNKKFTDALEIMAESYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKALKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNNAYGTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1981 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgattagcaataccccggagggggaggtgccgagcgttatcgcccgcccggttagtcagtacagctgccagcgcaagaccacgctgaataactacaacaaaaagtttaccgacgcgctggagatcatggccgagagctacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcaaaggccagtaagtcgctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagctcggtgaacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1982 - protein, 394 aa, synthetic construct
  REGION 1..394: note = Variant of terminal deoxynucleotidyl transferase
MHHHHHHGGSGHPISNTPEGEVPSVIARPVSQYSCQRKTTLNNYNKKFTDALEIMAESYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSSVNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1983 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagagctacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1984 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAESYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1985 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgccgagccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagacgcaaaggccagtaagagtctgaagctgagcaagatgcagaaggcgggcctgctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 1986 - protein, 394 aa, synthetic construct
  REGION 1..394: note = Variant of terminal deoxynucleotidyl transferase
MHHHHHHGGSGHPPSNTPEGEVPSVIAEPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEDAKASKSLKLSKMQKAGLLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 1987 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgccgggccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcaaaggccagtaagagtctgaagctgagcaagatgcagaaggcgggctttctgtattacgaggatctggcgagccgcgttagtaaagaagaagccgatgttgttacggtcatcgtgaagaatacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1988 - protein, 394 aa, synthetic construct
  REGION 1..394: note = Variant of terminal deoxynucleotidyl transferase
MHHHHHHGGSGHPPSNTPEGEVPSVIAGPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADVVTVIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1989 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcgcgtatgggacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1990 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAYGTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1991 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgccgggccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcacgtgccagtaagagtctgaagctgagcaagatgcagaaggcgggcctgctgtattacgaggatctggcgagccgcgttagtaaagaagaagccgatgttgttacggtcatcgtgaagaatacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccgtccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 1992 - protein, 394 aa, synthetic construct
  REGION 1..394: note = Variant of terminal deoxynucleotidyl transferase
MHHHHHHGGSGHPPSNTPEGEVPSVIAGPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEARASKSLKLSKMQKAGLLYYEDLASRVSKEEADVVTVIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYRPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 1993 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgccgggccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcaaaggccagtaagagtctgaagctgagcaagatgcagaaggcgggctttctgtattacgaggatctggcgagccgcgttagtaaagaagaagccgatgccgttacgctcatcgtgaagaatacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacggcagctataacacgagtaagggtagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 1994 - protein, 394 aa, synthetic construct
  REGION 1..394: note = Variant of terminal deoxynucleotidyl transferase
MHHHHHHGGSGHPPSNTPEGEVPSVIAGPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNGSYNTSKGSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 1995 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1996 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1997 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcacgtgccagtaagagtctgaagctgagcaagatgcagaaggcgggctttctgtattacgaggatctggcgagccgcgttagtaaagaagaagccgatgctgttacggtcatcgtgaagaatacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccgtccgggcgtggataacagcagctataacacgagtaagggtagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 1998 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEARASKSLKLSKMQKAGFLYYEDLASRVSKEEADAVTVIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYRPGVDNSSYNTSKGSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 1999 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgattagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 2000 - protein, 394 aa, synthetic construct
  REGION 1..394: note = Variant of terminal deoxynucleotidyl transferase
MHHHHHHGGSGHPISNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 2001 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaggcaaaggccagtaagtcgctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 2002 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 2003 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgctgttacggtcatcgtgaagaatacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccgtccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 2004 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTVIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYRPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 2005 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagacgagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 2006 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKTSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 2007 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2008 - protein, 394 aa, synthetic construct; identical to SEQ ID NO: 1928
  REGION 1..394: note = Variant of terminal deoxynucleotidyl transferase

SEQ ID NO: 2009 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacgcttgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 2010 - protein, 394 aa, synthetic construct
  REGION 1..394: note = Variant of terminal deoxynucleotidyl transferase
MHHHHHHGGSGHPPSNTPEGEVPSVIARPVSQYACQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 2011 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattttcaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 2012 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASIFKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 2013 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacttcaaaaagcgcatctttctgaaagcgggcagcgaagaagagattttcgcgcatctgggtctggattatgtggagccgtgggaacgcaacgcg

SEQ ID NO: 2014 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDFKKRIFLKAGSEEEIFAHLGLDYVEPWERNA

SEQ ID NO: 2015 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgctgagctgctccacaaagtggttgatctgctcaagaagcaaggtctgctgctgtacgaagacatcaaagagagcacgttcgtggaggggcaactgccaagtcacaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 2016 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDAELLHKVVDLLKKQGLLLYEDIKESTFVEGQLPSHKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 2017 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagctgaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 2018 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKLTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 2019 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggtccgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 2020 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAVRVDLVITPFEQYAYALLGWTGSKEFRRDLRRYAEEERGMILDNHALYDRKKRIFLKAGSEEEIFAHLGLDYVEPWERNA

SEQ ID NO: 2021 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagacgcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 2022 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKTQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 2023 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtggcaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 2024 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSGKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 2025 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcggcaagcgcatctttctgaaagcgggcagcgaagaagagattttcgcgcatctgggtctggattatgtggagccgtgggaacgcaacgcg

SEQ ID NO: 2026 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRGKRIFLKAGSEEEIFAHLGLDYVEPWERNA

SEQ ID NO: 2027 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgccagatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 2028 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERQMILDNHALYDRKKRIFLKAGSEEEIFAHLGLDYVEPWERNA

SEQ ID NO: 2029 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtattgaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 2030 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACIEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 2031 - DNA, 1182 bp, synthetic construct
  misc_feature 1..1182: note = Variant of terminal deoxynucleotidyl transferase
  source 1..1182: mol_type = other DNA
atgcaccatcatcatcatcatggcggtagcggccatccgccgagcaataccccggagggggaggtgccgagcgttatcgcccgcccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaggcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgagaagaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgaccgcaaaaagcgcatctttctgaaagcgggcagcgaagaagagattttcgcgcatctgggtctggattatgtggagccgtgggaacgcaacgcg

SEQ ID NO: 2032 - protein, 394 aa, synthetic construct
  REGION 1..394: note = Variant of terminal deoxynucleotidyl transferase
MHHHHHHGGSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEKKDWKAIRVDLVITPFEQYAYALLGWTGSKEFRRDLRRYAEEERGMILDNHALYDRKKRIFLKAGSEEEIFAHLGLDYVEPWERNA

SEQ ID NO: 2033 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagttcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2034 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSSVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2035 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgattagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2036 - protein, 394 aa, synthetic construct
  REGION 1..394: note = Variant of terminal deoxynucleotidyl transferase
MHHHHHHGDSGHPISNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2037 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2038 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2039 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgattagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaaggcgctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2040 - protein, 394 aa, synthetic construct
  REGION 1..394: note = Variant of terminal deoxynucleotidyl transferase
MHHHHHHGDSGHPISNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWYRMGLRTVEEARASKALKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2041 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgaggattacaagtttaaagagaacctgatcgcgtgtctggaagccaagcgcgccgcgagtattctgaaatatctgccgttcgaagttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcgccggcggtttccgccgtggcaaacctgtaggccacgacgtcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2042 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAEDYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTIAGGFRRGKPVGHDVDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2043 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2044 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2045 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgattagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacaattcgtacaatacgagtaagggcagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2046 - protein, 394 aa, synthetic construct
  REGION 1..394: note = Variant of terminal deoxynucleotidyl transferase
MHHHHHHGDSGHPISNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNNSYNTSKGSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2047 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcacgcgccagtaaggcgctgaagctgagcaagatgcagaaggcgggctttctgtattacgaggatctggcgagccgcgttagtaaagaagaagccgatgttgttacgctgatcgtgaagaatacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacaatgcgtacgggacgagtaagggcagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2048 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWYRMGLRTVEEARASKALKLSKMQKAGFLYYEDLASRVSKEEADVVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNNAYGTSKGSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2049 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgccgggccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacaatgcggttaatacgagtaagggcagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2050 - protein, 394 aa, synthetic construct
  REGION 1..394: note = Variant of terminal deoxynucleotidyl transferase
MHHHHHHGDSGHPPSNTPEGEVPSVIAGPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNNAVNTSKGSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2051 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgccggcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcactggcggtttccgccgtggcaaacctgtaggccacgacgtcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2052 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLPACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPVGHDVDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2053 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctgtaggccacgacgtcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2054 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPVGHDVDFLITNPGPKEDDELLHKVVDLLKKQGLLLYEDIKESTFVEGQLPSRKIDAMDNFQKCFAILKLYQPGVDNSSYNTSKKSDMAEVKDWKAVRVDLVITPFEQYAYALLGWTGSKEFRRDLRRYAEEERGMILDNHALYDLKKRIFLKAGSEEEIFAHLGLDYVEPWERNA

SEQ ID NO: 2055 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaattacaagtttaaagagaacctgatcgcgtgtctggaagccaagcgcgccgcgagtattctgaaatatctgccgttcgaagttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcactggcggtttccgccgtggcaaacctgtaggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcggttcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2056 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPVGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAVRVDLVITPFEQYAYALLGWTGSKEFRRDLRRYAEEERGMILDNHALYDLKKRIFLKAGSEEEIFAHLGLDYVEPWERNA

SEQ ID NO: 2057 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgattagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcacgcgccagtaaggcgctgaagctgagcaagatgcagaaggcgggctttctgtattacgaggatctggcgagccgcgttagtaaagaagaagccgatgctgttacgctgatcgtgaaggagacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacaattcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2058 - protein, 394 aa, synthetic construct
  REGION 1..394: note = Variant of terminal deoxynucleotidyl transferase
MHHHHHHGDSGHPISNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEARASKALKLSKMQKAGFLYYEDLASRVSKEEADAVTLIVKETVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNNSVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2059 - DNA, 1179 bp, synthetic construct
  misc_feature 1..1179: note = Variant of terminal deoxynucleotidyl transferase
  source 1..1179: mol_type = other DNA
atgcaccatcatcatcatcatggcgatagcggccatccgattagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcaaaggccagtaagtcgctgaagctgagcaagatgcagaaggcgggctttctgtattacgaggatctggcgagccgcgttagtaaagaagaagccgatgctgttacggtgatcgtgaaggagacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtcgttgggcgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2060 - protein, 393 aa, synthetic construct
  REGION 1..393: note = Variant of terminal deoxynucleotidyl transferase
MHHHHHHGDSGHPISNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTVIVKETVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSRWASKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2061 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagtcgctgaagctgagcaagatgcagaaggcgggctttctgtattacgaggatctggcgagccgcgttagtaaagaagaagccgatgctgttacgctgatcgtgaaggagacggtgcgtacctttctgccggatgcgctggtgaccatcaccggcggtttccgccgtggcaaacctatgggccacgacattgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacaatgcgtacaatacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2062 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASRVSKEEADAVTLIVKETVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNNAYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2063 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagcccagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2064 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAQRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2065 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagtcgctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacattgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttaatacgagtaagggcagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2066 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSAVNTSKGSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2067 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgccgagccggttagtcagtacagctgccagcgcaagaccacgctgaataactacaacaaaaagtttaccgacgcgctggagatcatggccgagagctacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagtcgctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacaatgcggttgggacgagtaagggcagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2068 - protein, 394 aa, synthetic construct
  REGION 1..394: note = Variant of terminal deoxynucleotidyl transferase
MHHHHHHGDSGHPPSNTPEGEVPSVIAEPVSQYSCQRKTTLNNYNKKFTDALEIMAESYKFKENLIACLEAKRAASILKYLPFPVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNNAVGTSKGSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2069 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgattagcaataccccggagggggaggtgccgagcgttatcgccgggccggttagtcagtacagctgccagcgcaagaccacgctgaataactacaacaaaaagtttaccgacgcgctggagatcatggccgagagctacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2070 - protein, 394 aa, synthetic construct
  REGION 1..394: note = Variant of terminal deoxynucleotidyl transferase
MHHHHHHGDSGHPISNTPEGEVPSVIAGPVSQYSCQRKTTLNNYNKKFTDALEIMAESYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2071 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgccgagccggttagtcagtacagctgccagcgcaagaccacgctgaataactacaacaaaaagtttaccgacgcgctggagatcatggccgagagctacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcaaaggccagtaaggcgctgaagctgagcaagatgcagaaggcgggctttctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagttcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2072 - protein, 394 aa, synthetic construct
  REGION 1..394: note = Variant of terminal deoxynucleotidyl transferase
MHHHHHHGDSGHPPSNTPEGEVPSVIAEPVSQYSCQRKTTLNNYNKKFTDALEIMAESYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKALKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSSVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2073 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcctgctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagttcgtacaatacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2074 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEAKASKSLKLSKMQKAGLLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2075 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaattacaagtttaaagagaacctgatcgcgtgtctggaagcccagcgcgccgcgagtattctgaaatatctgccgttcccggttcaaagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcactggcggtttccgccgtggcaaacctgtaggccacgacatcgactttctgatcaccaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2076 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAQRAASILKYLPFPVQSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPVGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2077 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgccgggccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagtgcggttaatacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2078 - protein, 394 aa, synthetic construct
  REGION 1..394: note = Variant of terminal deoxynucleotidyl transferase
MHHHHHHGDSGHPPSNTPEGEVPSVIAGPVSQYSCQRKTTLNNYNKKFTDALEIMAENYKFKENLIACLEAKRAASILKYLPFEVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSAVNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2079 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcgatatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2080 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERDMILDNHALYDLKKRIFLKAGSEEEIFAHLGLDYVEPWERNA

SEQ ID NO: 2081 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgattagcaataccccggagggggaggtgccgagcgttatcgccgggccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacaattcggttaatacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2082 - protein, 394 aa, synthetic construct
  REGION 1..394: note = Variant of terminal deoxynucleotidyl transferase
MHHHHHHGDSGHPISNTPEGEVPSVIAGPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNNSVNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2083 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtttgctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2084 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASLLKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2085 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgccgagccggttagtcagtacagctgccagcgcaagaccacgctgaataactacaacaaaaagtttaccgacgcgctggagatcatggccgagagctacaaatttaaagagaacctgatcgcgtgtctggaagccaagcgcgccgcgagtattctgaaatatctgccgttcgaggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcacgcgccagtaaggcgctgaagctgagcaagatgcagaaggcgggctttctgtattacgaggatctggcgagccgcgttagtaaagaagaagccgatgctgttacggtgatcgtgaagaatacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacaattcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2086 - protein, 394 aa, synthetic construct
  REGION 1..394: note = Variant of terminal deoxynucleotidyl transferase
MHHHHHHGDSGHPPSNTPEGEVPSVIAEPVSQYSCQRKTTLNNYNKKFTDALEIMAESYKFKENLIACLEAKRAASILKYLPFEVTSMKDIQGLPCITDQVRDVIEEIIEEGESSRVKEVLNDERYKAFKQFTSVFGVGVKTAEKWFRMGLRTVEEARASKALKLSKMQKAGFLYYEDLASRVSKEEADAVTVIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNNSVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2087 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaaggagacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2088 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKETVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2089 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgaaggtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2090 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPKVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2091 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgctgttacggtgatcgtgaaggagacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacaattcgtacaatacgagtaagggcagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2092 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTVIVKETVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNNSYNTSKGSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2093 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacttgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2094 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASILKYLPFPVTSMKDIQGLPCITDQVRDLIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2095 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaaattctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2096 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEILNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2097 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaattacaagtttaaagagaacctgatcgcgtgtctggaagccgggcgcgccgcgagtattctgaaatatctgccgttcgaagttcaaagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcactggcggtttccgccgtggcaaacctatgggccacgacgtcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2098 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAGRAASILKYLPFEVQSMKDIQGLPCITDQVRDVIEEIIEEGESSRVKEVLNDERYKAFKQFTSVFGVGVKTAEKWFRMGLRTVEEAKASKSLKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2099 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgattagcaataccccggagggggaggtgccgagcgttatcgccgggccggttagtcagtacagctgccagcgcaagaccacgctgaataactacaacaaaaagtttaccgacgcgctggagatcatggccgagagctacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcaaaggccagtaaggcgctgaagctgagcaagatgcagaaggcgggctttctgtattacgaggatctggcgagccgcgttagtaaagaagaagccgatgttgttacggtgatcgtgaagaatacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2100 - protein, 394 aa, synthetic construct
  REGION 1..394: note = Variant of terminal deoxynucleotidyl transferase
MHHHHHHGDSGHPISNTPEGEVPSVIAGPVSQYSCQRKTTLNNYNKKFTDALEIMAESYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKALKLSKMQKAGFLYYEDLASRVSKEEADVVTVIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2101 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgattagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcctgctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2102 - protein, 394 aa, synthetic construct
  REGION 1..394: note = Variant of terminal deoxynucleotidyl transferase
MHHHHHHGDSGHPISNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWYRMGLRTVEEAKASKSLKLSKMQKAGLLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2103 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgattagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtaccgtatgggcctccgtacggttgaagaagcaaaggccagtaagagtctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2104 - protein, 394 aa, synthetic construct
  REGION 1..394: note = Variant of terminal deoxynucleotidyl transferase
MHHHHHHGDSGHPISNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWYRMGLRTVEEAKASKSLKLSKMQKAGFLYYEDLASRVSKEEADAVTLIVKNTVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2105 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgccgagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggtttcgtatgggcctccgtacggttgaagaagcaaaggccagtaaggcgctgaagctgagcaagatgcagaaggcgggcttcctgtattacgaggatctggcgagccgcgttagtaaagaagaagccgatgccgttacgctcatcgtgaagaacacggtgcgtacctttctgccggatgcgctggtgaccatcaccggcggtttccgccgtggcaaacctatgggccacgacgttgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacagcagctataacacgagtaagaagagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2106 - protein, 394 aa, synthetic construct
  REGION 1..394: note = Variant of terminal deoxynucleotidyl transferase
MHHHHHHGDSGHPPSNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKALKLSKMQKAGFLYYEDLASRVSKEEADAVTLIVKNTVRTFLPDALVTITGGFRRGKPMGHDVDFLITNPGPKEDDELLHKVVDLLKKQGLLLYEDIKESTFVEGQLPSRKIDAMDNFQKCFAILKLYQPGVDNSSYNTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

SEQ ID NO: 2107 - DNA, 1182 bp, synthetic construct
  misc_feature 1..1182: note = Variant of terminal deoxynucleotidyl transferase
  source 1..1182: mol_type = other DNA
atgcaccatcatcatcatcatggcgatagcggccatccgattagcaataccccggagggggaggtgccgagcgttatcgcccgtccggttagtcagtacagctgccagcgcaagaccacgctgaataactacaacaaaaagtttaccgacgcgctggagatcatggccgagaactacaaatttaaagagaacctgatcgcgtgtctggaagccaagcgcgccgcgagtattctgaaatatctgccgttcccggttaccagcatgaaagacatccaaggtctgccgtgcattaccgaccaagttcgtgacgtgatcgaggagatcatcgaagagggcgagagcagccgtgttaaagaagttctcaatgacgagcgctacaaggcctttaagcagttcaccagcgtgttcggtgtgggcgtgaaaaccgcggaaaagtggttccgtatgggcctccgtacggttgaagaagcaaaggccagtaagtcgctgaagctgagcaagatgcagaaggcgggcctgctgtattacgaggatctggcgagccgcgttagtaaagaagaagccgatgctgttacggtgatcgtgaaggagacggtgcgtacctttctgccggatgcgctggtgaccatcaccggcggtttccgccgtggcaaacctatgggccacgacatcgactttctgatcacgaatccgggcccgaaagaggatgacgagctgctccacaaagtggttgatctgctcaagaagcaaggtctgctgctgtacgaagacatcaaagagagcacgttcgtggaggggcaactgccaagtcgcaaaatcgacgccatggacaacttccagaagtgcttcgccattctcaagctgtaccagccgggcgtggataacaatgcggttgggacgagtaagaaaagtgacatggccgaggttaaggattggaaagcgattcgtgtggatctggtgatcacgccattcgagcagtacgcctatgcgctgctcggttggacgggcagcaaagaatttcgtcgcgatctgcgccgctatgcggaggaagagcgcggcatgatcctcgacaaccatgccctctacgacctgaaaaagcgcatctttctgaaagcgggcagcgaagaagagattttcgcgcatctgggtctggattatgtggagccgtgggaacgcaacgcg

SEQ ID NO: 2108 - protein, 394 aa, synthetic construct
  REGION 1..394: note = Variant of terminal deoxynucleotidyl transferase
MHHHHHHGDSGHPISNTPEGEVPSVIARPVSQYSCQRKTTLNNYNKKFTDALEIMAENYKFKENLIACLEAKRAASILKYLPFPVTSMKDIQGLPCITDQVRDVIEEIIEEGESSRVKEVLNDERYKAFKQFTSVFGVGVKTAEKWFRMGLRTVEEAKASKSLKLSKMQKAGLLYYEDLASRVSKEEADAVTVIVKETVRTFLPDALVTITGGFRRGKPMGHDIDFLITNPGPKEDDELLHKVVDLLKKQGLLLYEDIKESTFVEGQLPSRKIDAMDNFQKCFAILKLYQPGVDNNAVGTSKKSDMAEVKDWKAIRVDLVITPFEQYAYALLGWTGSKEFRRDLRRYAEEERGMILDNHALYDLKKRIFLKAGSEEEIFAHLGLDYVEPWERNA

(The sequence listing continues in the following parts.)

What is claimed is:

1. An engineered terminal deoxynucleotidyl transferase comprising a a polypeptide sequence having at least 90% sequence identity to SEQ ID NO: 5296, wherein the engineered terminal deoxynucleotidyl transferase comprises C68R in its polypeptide sequence, and wherein said engineered terminal deoxynucleotidyl transferase has terminal deoxynucleotidyl transferase activity and wherein the amino acid positions of the polypeptide sequence are numbered with reference to SEQ ID NO: 5296.

2. The engineered terminal deoxynucleotidyl transferase of claim 1, further comprising a residue difference(s) or a residue difference set(s) at amino acid positions selected from 14, 17, 19, 20, 21, 22, 24, 27, 28/304, 55, 66, 67, 80, 99, 103, 111, 113, 115, 140, 158, 159, 160, 161, 167, 170, 180, 192, 197, 200, 201, 219, 233, 235, 238, 246, 249, 256, 258, 267, 268, 273, 295, 296, 297, 300, 303, 304, 306, 322, 350, 353, 367, and 373, and/or any combinations thereof.

3. The engineered terminal deoxynucleotidyl transferase of claim 1, further comprising a residue difference(s) or a residue difference set(s) at amino acid positions selected from 10, 17, 20, 27, 28, 55, 62, 63, 66, 67, 68/118, 87, 103, 106, 111, 131, 155, 157, 160, 160/296, 177, 181, 200, 219, 246, 256, 263, 292, 295, 296, 297, 315, and 373, and/or any combinations thereof.

4. The engineered terminal deoxynucleotidyl transferase of claim 1, further comprising a residue difference(s) or a residue difference set(s) at amino acid positions selected from 8, 10, 11, 15, 16, 20, 21, 22, 24, 26, 28, 30, 34, 42, 44, 47, 48, 52, 54, 55, 62, 63, 66, 67, 72, 77, 80, 84, 87, 89, 91, 92, 99, 101, 102, 103, 106, 109, 111, 111/346, 113, 115, 116, 118, 122, 123, 131, 140, 144, 147, 156, 157, 160, 160/296, 161, 162, 163, 164, 170, 173, 174, 175, 180, 181, 185, 189, 192, 193, 194, 197, 198, 198/289, 200, 201, 207, 219, 230, 234, 235, 237, 238, 241, 245, 246, 249, 256, 257, 258, 262, 263, 264, 267, 268, 272, 273, 280, 284, 286, 289, 290, 291, 292, 295, 296, 297, 299, 300, 302, 304, 307, 308, 310, 311, 321, 322, 325, 350, 353, 355, 365, 366, 368, 371, 373, and 388, and/or any combinations thereof.

5. The engineered terminal deoxynucleotidyl transferase of claim 1, further comprising a residue difference(s) or a residue difference set(s) at amino acid positions selected from 60, 60/259, 60/278, and 65/259, and/or any combinations thereof.

6. The engineered terminal deoxynucleotidyl transferase of claim 1, further comprising a residue difference(s) or a residue difference set(s) at amino acid positions selected from 20, 20/21/68/103/200/238/297, 20/21/68/111/235, 20/21/68/160, 20/21/68/160/180/200/246, 20/21/68/160/246, 20/21/68/180, 20/21/68/180/235, 20/21/68/200/235/297, 20/21/68/233/246/297, 20/21/103/233, 20/21/111, 20/21/111/160/200, 20/21/111/200/238, 20/21/180/297, 20/21/233, 20/68/103/160/200, 20/68/103/180/200, 20/68/160, 20/68/160/180, 20/68/160/180/233/235/246, 20/68/160/235/297, 20/68/160/246, 20/68/200/238/246, 20/68/235/297, 20/103/160/180/200/235, 20/103/233, 20/111, 20/111/180/235/246/297, 21, 21/68, 21/68/103/111, 21/68/111/200, 21/68/160/180/200/205/297, 21/68/160/180/200/297, 21/68/160/238, 21/68/160/238/246, 21/68/180, 21/68/180/235, 21/68/180/246, 21/68/200, 21/68/235, 21/103/233, 21/233/297, 68/103/160/235, 68/103/200/235/246/297, 68/111/200/238, 68/111/233/236/297, 68/160/233/246, 68/200/235/297, 103, 103/160/180, 103/160/297, 103/233, 111, and 111/160/233/235/297, and/or any combinations thereof.

7. The engineered terminal deoxynucleotidyl transferase of claim 1, further comprising a residue difference(s) or a residue difference set(s) at amino acid positions selected from 9, 9/28/156/158/173/190/193/303/364, 9/28/156/158/290/364, 9/28/190/193/303/364, 9/28/290/303/364, 9/156/158/193/290/303/364, 9/156/364, 9/290/364, 9/364, 14, 14/58/84/147/162/224/296/297/298/299, 14/58/84/147/162/224/296/297/299, 14/58/84/224/298, 14/84/147/193/197/224/296, 14/84/162/224/297/299, 14/84/224/296/299, 14/162/224/298/299, 14/224/296/298, 23/28/156/158/190/193/290/364, 28/156/173/364, 28/158/173/190/193/290/364, 28/190/193, 28/296/303/364, 28/364, 58/147/162/197/224/296/297/298/299, 58/162/224/296/298, 58/224, 58/224/299, 84/147, 147/224, 147/224/297/298, 156/158/190/193/364, 158/193/290/303, 193/290, 224/296/298, 224/297/299, 290/303/364, 303, and 364, and/or any combinations thereof.

8. The engineered terminal deoxynucleotidyl transferase of claim 1, further comprising a residue difference(s) or a residue difference set(s) at amino acid positions selected from 9, 34, 48, 69, 78, 237/271, 249, 302, 309, 315, 353, 364, and 365, and/or any combinations thereof.

9. The engineered terminal deoxynucleotidyl transferase of claim 1, further comprising a residue difference(s) or a residue difference set(s) at amino acid positions selected from 200, 201, 202, 203, 226, 229, 230, 234, 235, 236, 237, 238, 324, 326, 342, 344, 352, 355, 360, 366, 369, 371, 373, 374, 377, 378, 383, 388, and 390, and/or any combinations thereof.

10. The engineered terminal deoxynucleotidyl transferase of claim 1, further comprising a residue difference(s) or a residue difference set(s) at amino acid positions selected from 200, 203, 226, 234, 237, 342, 350, 360, 366, 369, 373, 377, 378, 380, and 390, and/or any combinations thereof.

11. The engineered terminal deoxynucleotidyl transferase of claim 1, further comprising a residue difference(s) or a residue difference set(s) at amino acid positions selected from 200, 201, 203, 207, 226, 230, 233, 234, 235, 322, 342, 344, 352, 355, 360, 366, 371, 373, 374, 378, and 387, and/or any combinations thereof.

12. The engineered terminal deoxynucleotidyl transferase of claim 1, further comprising a residue difference(s) or a residue difference set(s) at amino acid positions selected from 15, 200, 202, 203, 205, 206, 207, 226, 229, 230, 231, 233, 234, 237, 321, 324, 326, 327, 330, 342, 344, 349, 352, 353, 360, 366, 369, 371, 373, 374, 378, 380, 386, 387, 388, and 390, and/or any combinations thereof.

13. The engineered terminal deoxynucleotidyl transferase of claim 1, further comprising a residue difference(s) or a residue difference set(s) at amino acid positions selected from 55/80/174/268/355/366, 55/80/268/315/366, 55/80/268/346, 55/111/156/268/315/324/327/366/373, 55/111/268/346/355, 55/111/268/355/366, 55/111/315/355/373, 55/268, 55/268/315/346, 55/268/324/366, 55/268/346/355, 62/66/69/143/338/353, 62/66/100/101/104/203/235/338, 62/69/80/101/104/143/235/338, 62/203/211/235/338/350, 66/69/143/235/338, 69/80/203/211/278/338, 80/111/268/324/327/346/366/373, 80/111/355/366, 80/143/203/211/338, 80/268/315/346/355, 80/268/327/346/366, 80/268/346, 80/315/346/364/373, 80/346/366, 100/101/211/278/338/350/353, 111/268, 268, 268/315/327/346, 268/315/346, 268/315/346/366, 268/315/355, 268/324, 268/324/327/346, 268/327/346, 268/346, 268/346/355, 268/355/366, 315/324/327/355/366, 324/346/355/366, and 327/346, and/or any combinations thereof.

14. The engineered terminal deoxynucleotidyl transferase of claim 1, further comprising a residue difference(s) or a residue difference set(s) at amino acid positions selected from 29/77/104/234/271, 29/77/104/234/271/279/380, 29/77/182/207/271, 29/77/207/234/279/380, 29/77/234/271/279/368, 29/77/271, 29/104/234/271/279/380, 29/182/207/380, 29/182/234/271/380, 29/182/271/279/380, 29/234/279/380, 29/271/279, 29/271/279/368/380, 32/78/106/200/226/272/373, 32/78/106/200/226/373, 32/78/106/226, 32/78/200/226, 32/78/200/226/235/272, 32/78/200/226/235/321/373, 32/78/226, 32/78/226/321, 32/78/226/373, 32/106/200/226, 32/106/200/226/235/373, 32/200/226, 32/200/226/321/373, 32/226, 77/182/279/380, 77/182/368, 77/234/271/279/380, 78/106, 78/106/226/321/373, 78/106/235/321/373, 78/200/226/321/373, 78/226/321, 104/182, 106/200/226/373, 106/226/235/373, 182/207/279/368, 182/234/380, 182/279/368/380, 200/226, 200/226/321/373, 200/226/373, 207/271/368/380, 207/380, 226, 226/235/272/373, 226/272/373, and 271/380, and/or any combinations thereof.

15. The engineered terminal deoxynucleotidyl transferase of claim 1, further comprising a residue difference(s) or a residue difference set(s) at amino acid positions selected from 32, 32/161/193/237/360, 32/162, 32/162/193/267, 32/162/237/265/266, 32/162/302, 32/302, 53/163/201/325/

329, 53/200/201/325/329, 53/201, 53/201/275/280, 154, 154/166, 154/166/210/296, 154/339, 156/210/339, 161/162, 161/237, 162, 162/193/232/267/302/360, 162/237/265/266/267/302, 162/265, 162/267/360, 166/210, 166/296, 166/346/347, 167/210/346/349, 193/267, 201/371, 210/339, 237, 237/265, 237/266/360, 237/360, 339, and 371, and/or any combinations thereof.

16. The engineered terminal deoxynucleotidyl transferase of claim 1, further comprising a residue difference(s) or a residue difference set(s) at amino acid positions selected from 32, 32/162, 32/162/193, 32/162/193/267, 32/162/237/265/266, 32/162/302, 53/163/201/325/329, 53/200/201/325/329, 53/201, 53/201/275/280, 53/201/371, 82/154/296, 154, 154/166, 154/166/210/296, 154/166/346/347, 154/166/347, 154/167/210/347/349, 154/296/347, 154/339, 154/347, 156/166/167, 161/162, 161/237, 162, 162/193/232/267/302/360, 162/237/265/266/267/302, 162/265, 162/267/360, 163/201, 164/275/280, 166/210, 166/296, 166/346/347, 193/267, 201/371, 210/339, 237, 237/265, and 339, and/or any combinations thereof.

17. The engineered terminal deoxynucleotidyl transferase of claim 1, further comprising a residue difference(s) or a residue difference set(s) at amino acid positions selected from 65, 65/184/187, 82/184/220/386, 154, 154/184, 154/187/220/350/386, 154/293, 154/350, 154/386, 184/187, 184/293, 187/220/350, 187/293, 220, 220/293, 293, 293/350, 293/350/386, 350, and 386, and/or any combinations thereof, wherein the amino acid positions are numbered with reference to SEQ ID NO: 5296.

18. The engineered terminal deoxynucleotidyl transferase of claim 1, further comprising a residue difference(s) or a residue difference set(s) at amino acid positions selected from 157, 160, 186, 188, 189, 190, 191, 192, 193, 194, 195, 196, 197, 198, 199, 200, 201, 202, 203, 204, 206, 209, 210, 211, 227, 229, 230, 233, 234, 235, 236, 237/381, 238, 241, 242, 243, 247, 253, 258, 260, 267, 272, 278, 282, 286, 288, 290, 292, 297, 298, 299, 327, 331, 368, 373, and 381, and/or any combinations thereof, wherein the amino acid positions are numbered with reference to SEQ ID NO: 5296.

19. The engineered terminal deoxynucleotidyl transferase of claim 1, further comprising a residue difference(s) or a residue difference set(s) at amino acid positions selected from 160, 186, 188, 189, 190, 191, 192, 193, 194, 195, 196, 197, 199, 200, 201, 202, 203, 204, 209, 210, 211, 229, 230, 233, 234, 235, 236, 237/381, 238, 241, 243, 244, 247, 253, 260, 278, 286, 288, 292, 297, 298, 299, 327, 331, 368, 373, and 381, and/or any combinations thereof, wherein the amino acid positions are numbered with reference to SEQ ID NO: 5296.

20. The engineered terminal deoxynucleotidyl transferase of claim 1, further comprising a residue difference(s) or a residue difference set(s) at amino acid positions selected from 65, 65/70/155/209/228, 65/128/209/371/373, 65/151, 65/155/209, 65/155/209/352/353, 65/159, 65/209/219/352/353, 65/209/352/353/371, 65/228/352/353/373, 65/228/371/373, 65/352/353/371, 128/159/209/352/353, 128/209, 128/209/219, 128/209/219/352/353/371, 128/209/228/371, 128/209/371, 128/209/371/373, 128/209/373, 128/338/352/353/373, 151/209, 151/209/371, 151/209/373, 151/228/352/353/373, 151/228/373, 151/352/353, 151/352/353/371/373, 155, 155/209, 155/228/352/353, 159/209/352/353, 208/209, 209, 209/219/352/353/371, 209/219/371, 209/228, 209/352/353/371, 209/371, 209/371/373, 209/373, 219/228, 219/352/353/371/373, 219/371/373, 228, 228/371, 228/371/373, 228/373, 352/353, 352/353/371, 371, 371/373, and 373, and/or any combinations thereof, wherein the amino acid positions are numbered with reference to SEQ ID NO: 5296.

21. The engineered terminal deoxynucleotidyl transferase of claim 1, further comprising a residue difference(s) or a residue difference set(s) at amino acid positions selected from 55/65/151, 65, 65/70/155/209/228, 65/70/228/373, 65/128, 65/128/155/209/371, 65/128/159/209/371/373, 65/128/209/371, 65/128/209/371/373, 65/128/219/373, 65/128/373, 65/151, 65/155/209, 65/155/209/352/353, 65/159, 65/209/219/352/353, 65/209/352/353/371, 65/219/371, 65/228/352/353/373, 65/228/371, 65/228/371/373, 65/352/353, 65/352/353/371, 65/373, 70/155/352/353, 128, 128/155/209, 128/159, 128/159/209/352/353, 128/209, 128/209/219, 128/209/219/352/353/371, 128/209/228/371, 128/209/371, 128/209/371/373, 128/209/373, 128/219/352/353, 128/219/371/373, 128/228/352/353, 128/228/371, 128/228/373, 128/352/353, 128/352/353/373, 128/371, 128/371/373, 128/373, 151, 151/155, 151/155/209, 151/155/209/219/228/371/373, 151/155/209/373, 151/155/219/352/353/371, 151/155/352/353, 151/155/352/353/371/373, 151/155/352/353/373, 151/209, 151/209/371, 151/209/371/373, 151/209/373, 151/219, 151/219/371, 151/228/352/353/373, 151/228/373, 151/352/353, 151/352/353/371/373, 151/371, 151/373, 155, 155/209, 155/219, 155/228/352/353, 155/228/371, 155/228/371/373, 155/352/353/373, 155/371, 155/371/373, 155/373, 159/209/352/353, 209, 209/219/352/353/371, 209/219/371, 209/228, 209/352/353/371, 209/371, 209/371/373, 209/373, 219, 219/228, 219/352/353/371/373, 219/352/353/373, 219/371, 219/371/373, 228/352/353, 228/371, 228/371/373, 228/373, 352/353, 352/353/371, 352/353/373, 371, 371/373, and 373, and/or any combinations thereof, wherein the amino acid positions are numbered with reference to SEQ ID NO: 5296.

22. The engineered terminal deoxynucleotidyl transferase of claim 1 comprising a polypeptide sequence having at least 90% sequence identity to a sequence of SEQ ID NO: 5628, 5630, 5632, and/or 5636, and wherein the amino acid positions of the polypeptide sequence are numbered with reference to SEQ ID NO: 5628, 5630, 5632, and/or 5636.

23. The engineered terminal deoxynucleotidyl transferase of claim 1 comprising a polypeptide sequence selected from the even-numbered sequences of SEQ ID NO: 5624-6766.

24. The engineered terminal deoxynucleotidyl transferase of claim 1, wherein the engineered terminal deoxynucleotidyl transferase further comprises a residue difference(s) or a residue difference set(s) at an amino acid position selected from 8, 9, 10, 11, 12, 14, 15, 16, 17, 18, 19, 20, 21, 22, 23, 24, 26, 27, 28, 29, 30, 32, 34, 36, 38, 40, 42, 44, 47, 48, 49, 50, 51, 52, 53, 54, 55, 56, 57, 58, 59, 60, 61, 62, 63, 64, 65, 66, 67, 69, 70, 71, 72, 73, 74, 75, 77, 78, 79, 80, 82, 84, 85, 86, 87, 89, 91, 92, 93, 94, 96, 97, 98, 99, 100, 101, 102, 103, 104, 105, 106, 107, 108, 109, 110, 111, 112, 113, 115, 116, 117, 118, 119, 120, 122, 123, 124, 125, 127, 131, 133, 134, 135, 136, 140, 141, 143, 144, 145, 147, 148, 153, 154, 155, 156, 157, 158, 159, 160, 161, 162, 163, 164, 165, 166, 167, 168, 170, 173, 174, 175, 176, 177, 180, 181, 182, 184, 185, 186, 187, 189, 190, 192, 193, 194, 196, 197, 198, 200, 201, 202, 203, 204, 205, 206, 207, 209, 210, 211, 217, 219, 220, 224, 226, 228, 229, 230, 231, 232, 233, 234, 235, 236, 237, 238, 239, 241, 242, 243, 244, 245, 246, 248, 249, 250, 252, 253, 256, 257, 258, 259, 260, 261, 262, 263, 264, 265, 266, 267, 268, 269, 270, 271, 272, 273, 274, 275, 276, 277, 278, 279, 280, 282, 284, 286, 287, 288, 289, 290, 291, 292, 293, 294, 295, 296, 297, 298, 299, 300, 301, 302, 303, 304, 305, 306, 307, 308, 309, 310, 311, 315, 319, 321, 322, 323, 324, 325, 326, 327, 328, 329, 330, 332, 338, 339, 340, 341, 342, 344, 345, 346, 347, 349, 350, 351, 352, 353, 355, 358, 360, 361, 364, 365, 366, 367, 368, 369, 370, 371, 372, 373, 374, 376, 377, 378, 380, 383, 384, 386, 387, 388, and 390, and/or any combinations thereof, wherein the amino acid positions of the polypeptide sequence are numbered with reference to SEQ ID Nos: 5296, 5628, 5630, 5632, and/or 5636.

25. The engineered terminal deoxynucleotidyl transferase of claim 1, further comprising a residue difference(s) or a residue difference set(s) at an amino acid position selected from 8, 9, 9/11, 9/14/190/197/364, 9/14/58, 9/14/58/182/190/197/298, 9/28/156/158/173/190/193/303/364, 9/28/156/158/290/364, 9/28/190/193/303/364, 9/28/290/303/364, 9/58/197, 9/156/158/193/290/303/364, 9/156/364, 9/290/364, 9/298, 9/302, 9/364, 10, 10/14/197/364, 11, 12, 14, 14/15/200/230, 14/15/77/200/226/230, 14/15/77/78, 14/15/77/78/200/201/226/230/290, 14/15/77/78/200/203/230/290, 14/15/77/78/203/226/230/290, 14/15/78, 14/15/78/226/230, 14/28/224/296/298, 14/28/58/162/190/193/224, 14/28/58/224, 14/28/58/84/173/297, 14/58/147/162/190/193/224/296/303, 14/58/158/224, 14/58/162, 14/58/182/197/298/364, 14/58/84/147/162/224/296/297/298/299, 14/58/84/147/162/224/296/297/299, 14/58/84/224/298, 14/77/201/230, 14/77/78/200/226/230/257, 14/77/78/226/230/257, 14/78/200/201/226/290, 14/78/200/201/339, 14/78/200/226/230/339, 14/78/200/226/290/339, 14/78/200/230/339, 14/84/147/193/197/224/296, 14/84/162/224/297/299, 14/84/224/296/299, 14/147, 14/147/158/162/224, 14/147/173, 14/147/224, 14/158/162/197/224/296/298/299, 14/162/224/298/299, 14/173/193/197/296/297/298/299, 14/190/197/298, 14/193/197/224/297/298/299/300, 14/197/298/364, 14/200/203/226/230, 14/200/203/226/230/257/339, 14/200/203/230/339, 14/201/203/226, 14/224/296/298, 14/224/296/303, 14/298/364, 15, 15/77, 15/77/200/201/203/226/230/290/339, 15/77/200/230, 15/77/200/230/290/339, 15/77/201/226/230/339, 15/77/226/230/290/339, 15/77/78, 15/77/78/200/201/203/226/230, 15/78/201, 15/78/201/203/230, 15/78/201/230/290, 15/78/203/226/230, 15/200, 15/201/203/226/230/257/339, 15/226/230/339, 15/230, 16, 17, 18, 18/28/147/303, 19, 20, 20/21, 20/21/103/233, 20/21/111, 20/21/111/157/315, 20/21/111/160/200, 20/21/111/200/238, 20/21/111/246, 20/21/180/297, 20/21/233, 20/21/315, 20/21/52/67/68/87/111/157/160/173/180/200/235/246/315, 20/21/55/67/68/87/111/157/160/180/181/200/235/246/256/315/350, 20/21/55/67/68/87/111/157/160/180/200/246/256/315, 20/21/60/72/160/180/200/246/259/338/358, 20/21/67, 20/21/67/160, 20/21/67/68/87/111/157/160/180/200/235/246/315, 20/21/67/68/87/111/157/160/180/200/246/315, 20/21/67/87, 20/21/67/87/111, 20/21/67/87/111/200, 20/21/67/87/111/315, 20/21/67/87/157/180, 20/21/67/87/246/315, 20/21/68/103/200/238/297, 20/21/68/111/235, 20/21/68/160, 20/21/68/160/180/200/246, 20/21/68/160/246, 20/21/68/180, 20/21/68/180/235, 20/21/68/200/235/297, 20/21/68/233/246/297, 20/21/87/111/246/315, 20/21/87/157/200, 20/21/87/180/246/315, 20/21/87/315, 20/67/87/111/180, 20/67/87/157/160/180/315, 20/68/103/160/200, 20/68/103/180/200, 20/68/111/157/160, 20/68/160, 20/68/160/180, 20/68/160/180/233/235/246, 20/68/160/200/246, 20/68/160/235/297, 20/68/160/246, 20/68/200/238/246, 20/68/235/297, 20/87/111/180, 20/87/157/160, 20/100, 20/100/104/111/242, 20/100/104/120/197/367, 20/100/104/197/203/242/292, 20/100/104/203/350/353, 20/100/111, 20/100/120/197/232/235/315/366/367, 20/100/197/292/315, 20/100/203, 20/100/232/292/366/367, 20/100/235/315/367, 20/103/160/180/200/235, 20/103/233, 20/104/111/120/203, 20/111, 20/111/180/235/246/297, 20/120/197/292, 20/120/235, 20/160/315, 20/200, 20/292, 21, 21/67/180/315, 21/67/200, 21/67/87/111/200, 21/67/87/157/246, 21/68, 21/68/103/111, 21/68/111/200, 21/68/160/180/200/205/297, 21/68/160/180/200/297, 21/68/160/238, 21/68/160/238/246, 21/68/180, 21/68/180/235, 21/68/180/246, 21/68/200, 21/68/235, 21/87/157/160, 21/87/160/200/315, 21/87/160/315, 21/87/200, 21/87/246/315, 21/103/233, 21/111, 21/157/160, 21/160/315, 21/200/315, 21/233/297, 21/246, 22, 23, 23/28/156/158/190/193/290/364, 23/186/256/309, 24, 26, 26/60/200, 26/60/200/203/229/234/267, 26/60/200/203/229/267, 26/60/200/203/229/267/290, 26/60/200/203/234/267, 26/60/200/203/292, 26/60/200/234/290, 26/60/203/229/234/290, 26/60/229/267, 26/60/29026/200, 26/200/203, 26/200/203/229, 26/200/290, 26/203/234/290/292, 26/229/234/360, 27, 28, 29, 29/77/104/234/271, 29/77/104/234/271/279/380, 29/77/182/207/271, 29/77/207/234/279/380, 29/77/234/271/279/368, 29/77/271, 29/98/143/266, 29/98/185/197/266, 29/98/185/266/296/299, 29/104/234/271/279/380, 29/143, 29/143/162, 29/143/170/193/197/266, 29/143/185/193/266, 29/158/266, 29/170/185/193/266/299, 29/182/207/380, 29/182/234/271/380, 29/182/271/279/380, 29/185/296, 29/193/197/296/297, 29/234/279/380, 29/271/279, 29/271/279/368/380, 30, 32, 32/72/339, 32/72/339/360, 32/78/106/200/226/272/373, 32/78/106/200/226/373, 32/78/106/226, 32/78/200/226, 32/78/200/226/235/272, 32/78/200/226/235/321/373, 32/78/226, 32/78/226/321, 32/78/226/373, 32/103, 32/103/106/111/322/324, 32/103/106/207/210/235/321/368, 32/103/207/210/344/349, 32/103/207/228/232/373, 32/103/207/321/344, 32/103/210/273/321/373, 32/103/273, 32/103/321/344, 32/106, 32/106/200/226, 32/106/200/226/235/373, 32/106/207/210/232, 32/106/210, 32/106/210/373, 32/106/235/321, 32/106/235/368, 32/106/273/321/373, 32/106/280, 32/111/235, 32/111/235/271/272/339, 32/111/235/339, 32/111/235/339/386, 32/111/235/386, 32/140/141/261/360, 32/140/339, 32/140/360, 32/141/180/244, 32/161/193/237/360, 32/162, 32/162/193, 32/162/193/267, 32/162/237/265/266, 32/162/302, 32/180/261/339, 32/200/226, 32/200/226/321/373, 32/207/210/273, 32/207/210/279, 32/207/210/368/373, 32/207/235, 32/207/273/279/321, 32/207/279, 32/207/344, 32/210/232/235/368, 32/210/232/273/321, 32/210/232/273/368/373, 32/210/273, 32/226, 32/235, 32/235/271/339, 32/235/272, 32/235/272/339, 32/235/272/386, 32/235/273, 32/235/339/386, 32/235/386, 32/244/261, 32/271/339, 32/272, 32/273/279/344/349, 32/273/344/373, 32/279, 32/279/321, 32/302, 32/321/324/360, 32/322/324/383/386, 32/324, 32/339, 34, 34/48/133/158/182/230/233/271/345, 34/48/147, 34/48/147/158/182/220/233/307, 34/48/147/182/230/233/249/307, 34/48/147/271, 34/48/182/233/249, 34/48/339, 34/48/78/133/147/182, 34/48/78/147/158, 34/48/78/147/182/220/233/249/307/315/339, 34/48/78/158/182/220/249/307, 34/48/78/158/182/233/315/345, 34/48/78/182/220/230/315, 34/48/78/182/220/233, 34/78, 34/78/147/182/220/249, 34/78/147/182/233/249/315, 34/78/147/182/233/271/339, 34/78/158, 34/78/158/182/315/345, 34/78/158/249, 34/78/182/233/307, 34/78/204/220/339, 34/78/220/271, 34/78/220/307/339, 34/78/315, 34/78/84/147/158/182/220, 34/78/84/158/230, 34/133/147/158/230/233/249, 34/147, 34/147/155/233/339, 34/147/158, 34/147/158/182/233, 34/147/158/182/249/271, 34/147/182, 34/147/182/220, 34/147/182/220/230/249/315/339, 34/147/182/220/230/339, 34/147/182/220/271/315, 34/147/182/233/271/339, 34/147/182/249/307/315/339, 34/147/182/315, 34/147/182/345, 34/147/220/271, 34/147/230/273/315/345, 34/147/233, 34/147/249, 34/147/315/339, 34/158/182/315/339/345, 34/158/220, 34/158/307, 34/182, 34/182/230/315, 34/182/307/339, 34/182/345, 34/220, 34/220/307, 34/220/307/345, 34/220/315/339, 34/220/339, 34/233, 34/271/339, 34/315/345, 34/339, 36, 38, 40, 42, 44, 44/193, 47, 48, 48/53/237/239, 48/78/147/158/182/220/230/307, 48/78/147/158/182/230/249/271/315, 48/78/147/158/233/249, 48/78/147/182/220/233/249/339/345, 48/78/147/182/220/315, 48/78/147/182/

230/233/249, 48/78/158/182/220/233/249, 48/78/158/230/339, 48/78/233/315/339, 48/147/158/182/220/230/249/271/307/315/339, 48/147/158/182/220/249/307/339, 48/147/158/182/220/315, 48/147/158/182/230/233, 48/147/158/182/233/345, 48/147/158/233, 48/147/158/307/345, 48/147/233, 48/147/233/345, 48/147/271/307/339, 48/158/182/230/233/249, 48/182, 48/182/307/315, 48/256/261, 48/339, 49, 50, 51, 52, 52/55/106/256, 52/55/181/235/256, 52/55/181/256, 52/99/181/235, 52/106/181/235/256, 52/106/235/256, 52/106/256, 52/173/235, 52/180, 52/180/200/235/315/349, 52/180/200/349, 52/180/349, 52/200, 52/200/315, 52/200/349, 52/200/349/350, 52/235, 52/235/256, 52/315, 52/315/349, 52/349, 52/349/350, 53, 53/73/75/237/239, 53/157/278/327/331, 53/162/327/331/368, 53/163/201/325/329, 53/200/201/325/329, 53/201, 53/201/275/280, 53/201/371, 53/219/358, 53/237, 54, 55, 55/58, 55/58/256, 55/58/256/350/373, 55/58/256/355, 55/58/350/351, 55/58/69/350/351, 55/58/99/256/351/373, 55/58/99/256/355, 55/58/99/351, 55/67, 55/67/106/111/157, 55/67/106/315, 55/67/111, 55/67/111/315, 55/67/315, 55/67/87, 55/67/87/106/111/315, 55/67/87/157/315, 55/80/174/268/355/366, 55/80/268/315/366, 55/80/268/346, 55/87, 55/87/106, 55/87/106/111/315, 55/87/106/315, 55/87/157, 55/87/157/207, 55/99/103, 55/99/181/256, 55/99/219/358/373, 55/99/256/350, 55/103/181, 55/103/219, 55/103/338, 55/106/111, 55/106/157, 55/111, 55/111/156/268/315/324/327/366/373, 55/111/268/346/355, 55/111/268/355/366, 55/111/315, 55/111/315/355/373, 55/157, 55/181/219, 55/181/235/256/350, 55/181/246, 55/181/358, 55/219/246/358, 55/219/256/338, 55/256, 55/256/259, 55/268, 55/268/315/346, 55/268/324/366, 55/268/346/355, 55/315, 56, 56/75/154/156/192/239/280/282, 56/75/192/239, 56/192/282/350, 57, 57/367, 58, 58/69/256/373, 58/72/211/315, 58/72/220/224, 58/84/211/220/224, 58/99, 58/99/351/355, 58/99/355, 58/147/162/197/224/296/297/298/299, 58/147/162/296/298, 58/162/224/296/298, 58/186/270, 58/197, 58/197/364, 58/224, 58/224/299, 58/256, 58/256/350/355, 58/350/355, 58/364, 59, 59/62/63/68, 59/62/63/68/103/234, 59/62/63/68/147, 60, 60/62/68/91/111/234/289, 60/106/111/235/360, 60/200/203/290, 60/200/229/234, 60/200/234, 60/200/234/267/290/292, 60/200/234/290, 60/203, 60/259, 60/278, 60/280/360, 61, 62, 62/63/68, 62/63/68/91/109/210, 62/63/68/91/147/205/210/234, 62/66/100/101/104/203/235/338, 62/66/69/143/338/353, 62/68/103, 62/68/111, 62/68/91/111/289, 62/69/100/235/268/346, 62/69/353, 62/69/80/101/104/143/235/338, 62/111/235/315/355, 62/111/235/324/346, 62/203/211/235/338/350, 62/235/268/327/346/350/353/355, 62/235/346/350/355, 62/315/327/353, 62/323/346/353/355, 63, 64, 65, 65/70/155/209/228, 65/128/209/371/373, 65/140, 65/140/192/193, 65/140/192/193/302, 65/151, 65/155/209, 65/155/209/352/353, 65/159, 65/184/187, 65/193, 65/209/219/352/353, 65/209/352/353/371, 65/220/339, 65/228/352/353/373, 65/228/371/373, 65/259, 65/352/353/371, 66, 66/69/143/235/338, 66/100/235/315/327/353/355, 66/111/346/353/355, 66/220/224, 66/235/268/346, 66/235/346, 66/235/373, 67, 67/87, 67/87/106/157, 67/87/111/157/160/315, 67/87/111/157/315, 67/87/157, 67/87/315, 67/106, 67/106/111, 67/106/111/315, 67/106/157, 67/111, 67/111/315, 67/157, 67/157/160/180, 67/157/160/315, 67/157/315, 67/160, 67/180/200, 67/180/200/315, 67/315, 68, 68/87, 68/103/160/235, 68/103/200/235/246/297, 68/106/200, 68/106/321/322, 68/111/200/238, 68/111/233/236/297, 68/118, 68/157/160/200/315, 68/160/233/246, 68/200, 68/200/235/297, 68/200/270/321, 68/270/321/322, 68/344, 68/344/383, 69, 69/80/203/211/278/338, 69/100, 69/100/111/298/353/355, 69/100/235, 69/100/353/366, 69/111/235, 69/111/235/300/353/355, 69/111/235/315, 69/220, 69/235/315, 69/235/353, 69/268, 69/268/324/327/353/355, 69/268/346, 69/268/346/353, 69/315/353, 69/324/327/346, 69/324/346/350, 69/324/353, 69/339, 69/353/355, 70, 70/71, 70/71/353, 70/72, 70/72/140/244/261/339, 70/72/141/244, 70/72/180/360, 70/134/353, 70/140/141/339, 70/261/339/360, 70/353, 70/360, 71, 71/77/133/353, 71/77/353, 71/353, 72, 72/74/200/272/339/347, 72/84/220/224/315, 72/84/86/224, 72/86/220, 72/180/244/339, 72/220/224, 72/220/315, 72/256/360, 72/360, 73, 74, 74/106/270/344, 74/200/339, 74/272, 75, 75/207/373/378, 75/233/344, 75/233/366, 75/237/350, 77, 77/78/200/226/339, 77/78/201/226/257/339, 77/78/203, 77/78/203/230/339, 77/133/353, 77/134/353, 77/182/279/380, 77/182/368, 77/200/201, 77/200/201/226/230/339, 77/200/203/230/257/339, 77/200/230, 77/234/271/279/380, 77/353, 78, 78/106, 78/106/226/321/373, 78/106/235/321/373, 78/127, 78/133/147/158/182/220/271/339, 78/135/182/233/249/315/345, 78/147/158/182, 78/147/158/182/230/249, 78/147/158/182/233/271/307/345, 78/147/158/182/339/345, 78/147/158/220/230/233/249/271/307/315/345, 78/147/158/249/307/315, 78/147/182/230/233/249, 78/147/182/249/307, 78/147/182/339/345, 78/147/230/307, 78/147/233, 78/147/249/271/339, 78/158/182, 78/158/182/233/271/315, 78/158/182/307/315/345, 78/182/220/339, 78/182/271/315/339, 78/200/226/321/373, 78/200/230, 78/203/230/290, 78/226/230, 78/226/290, 78/226/321, 78/233, 78/339, 79, 80, 80/111/268/324/327/346/366/373, 80/111/355/366, 80/143/203/211/338, 80/268/315/346/355, 80/268/327/346/366, 80/268/346, 80/315/346/364/373, 80/346/366, 82, 82/154/296, 82/184/220/386, 84, 84/92/173, 84/147, 84/147/197/296/297, 84/147/297/298/303, 84/156/173/204, 84/173/204/303, 84/173/224, 84/220/315, 84/224/297/298/299, 85, 86, 87, 87/106, 87/106/111/315, 87/111, 87/111/157/315, 87/111/200, 87/111/200/246, 87/157, 87/157/180/200, 87/157/315, 87/315, 89, 91, 91/109/111, 91/109/147/205/210/234, 92, 92/173/204/290/303, 93, 94, 96, 97, 98, 98/143/158/170/185/296/297, 98/143/162/266, 98/143/185/266, 98/162/193, 98/170/193/197, 98/185, 98/185/193/197/266/297, 99, 99/103/219, 99/235, 99/256/351/355, 100, 100/101/211/278/338/350/353, 100/111, 100/111/353, 100/120/197/242, 100/235/268/315/346, 100/235/268/346/355, 100/235/268/366/373, 100/235/346/350/353, 100/268/346, 100/268/366, 101, 102, 103, 103/106/207/321, 103/106/210, 103/106/360, 103/111/235/280/360, 103/111/235/321/324, 103/160/180, 103/160/297, 103/207/210/235/321, 103/210/232/235, 103/219/256, 103/219/338/358, 103/232/273, 103/233, 103/256, 103/259, 103/324, 104, 104/106, 104/106/111/200/201/235/268/368, 104/106/111/200/201/268, 104/106/111/201/235/368, 104/106/200/201/268, 104/120/232/353, 104/182, 104/200/207/237/344/373/387, 104/207/344/387, 105, 106, 106/111, 106/111/157, 106/111/200/201, 106/111/200/201/268/368, 106/111/200/235/368, 106/111/201, 106/111/201/368, 106/111/322/324/386, 106/111/322/383/386, 106/173/200/235/315, 106/173/388, 106/182/203/226/235/342/346, 106/200/201, 106/200/201/209/368, 106/200/201/235, 106/200/201/368, 106/200/226/373, 106/200/321/322/383, 106/201/235, 106/201/268, 106/207/210/232/235/321/368/373, 106/207/235/321/368, 106/226/235/373, 106/235, 106/235/273/373, 106/235/383/386, 106/270/344, 106/273, 106/315, 106/324, 107, 108, 109, 109/111/205/210/234/289, 110, 111, 111/157/180/200/315, 111/160/233/235/297, 111/173, 111/173/235/315, 111/197/242, 111/200/201/268, 111/200/368, 111/226, 111/226/321/344/346/369/387, 111/235, 111/235/268/327/346, 111/235/268/346, 111/235/271/339, 111/235/272/339/386, 111/235/280, 111/235/339, 111/235/346/350, 111/268, 111/272/339/386, 111/322/360, 111/327, 111/346, 112, 113, 113/355, 115, 116, 117, 118, 119, 120, 122, 123, 124, 125, 128, 128/159/209/352/353, 128/209, 128/209/2, 128/209/219,

128/209/219/352/353/371, 128/296, 131, 133, 133/135/307/315, 133/220/233/271, 133/307, 134, 134/353, 135, 136, 140, 140/141/256/261/339, 140/180/244/261/339/360, 140/192/193/302, 140/193/302, 141, 141/244/261/360, 141/244/360, 141/256/339/360, 141/261, 141/261/339, 141/360, 143, 143/158/197/266, 143/266/296/297, 144, 144/220, 145, 147, 147/158/162/190/224/296/297/299/303, 147/158/182/220/233, 147/158/182/230/233/249/271/339, 147/158/182/233/249, 147/158/182/233/271/307/339, 147/158/182/233/307/339, 147/158/182/233/315/345, 147/158/182/271/315, 147/158/182/315, 147/158/220/230/233/249/345, 147/158/220/249/315, 147/158/233/249, 147/182/220/233/345, 147/182/230/307/315/339, 147/182/233, 147/182/233/249, 147/182/249/271/307, 147/182/345, 147/210/234, 147/220, 147/224, 147/224/297/298, 147/232/233/271/315/339, 147/233/345, 147/249, 147/290/303/307, 147/339, 148, 149, 150/244/261/360, 151, 153, 154, 154/156/282/350, 154/166, 154/166/210/296, 154/166/346/347, 154/166/347, 154/167/210/347/349, 154/184, 154/187/220/350/386, 154/293, 154/296/347, 154/339, 154/347, 154/350, 154/386, 155, 155/220/325/339, 156, 156/158/190/193/364, 156/166/167, 156/210/339, 157, 157/160, 157/162, 157/162/241/242/260, 157/162/241/242/327/331, 157/162/241/278/331/368, 157/162/241/331, 157/162/242/260/331, 157/162/331, 157/315, 157/327/331, 157/368, 158, 158/182/220/230/249/307/339, 158/193/290/303, 158/233, 158/307, 158/315, 158/315/339, 159, 160, 160/296, 161, 161/162, 161/237, 162, 162/193/232/267/302/360, 162/224, 162/237/265/266/267/302, 162/241/278/327/331, 162/241/331, 162/242/368, 162/265, 162/267/360, 162/367/371, 163, 163/201, 164, 164/275/280, 165, 166, 166/210, 166/296, 166/346/347, 167, 167/210/346/349, 168, 169/390, 170, 170/193/197, 173, 173/204, 173/204/303, 173/297, 174, 175, 176, 177, 180, 180/339, 181, 182, 182/186/256/360, 182/197, 182/201/203/226/234/235/346, 182/201/203/226/234/342/346, 182/201/203/226/235, 182/201/203/226/235/346, 182/201/203/226/342/346, 182/201/203/268/346, 182/201/226/234/342/346, 182/201/226/235/346, 182/201/226/268/346, 182/201/342, 182/203/226, 182/207/279/368, 182/220/345, 182/226/234/268/342/346, 182/226/234/346, 182/226/235, 182/226/235/268/346, 182/226/235/342, 182/226/235/346, 182/226/268/342/346, 182/226/342, 182/226/346, 182/230, 182/230/233, 182/234/380, 182/256, 182/279/368/380, 182/298/364, 182/342/346, 182/345, 184, 184/187, 184/188/200/203/211/242, 184/188/200/203/242/297, 184/188/200/203/290/297/368, 184/188/203/290/297, 184/188/211/242/290/368, 184/189, 184/189/206/297/368, 184/189/297, 184/200, 184/206/242/290/297, 184/211, 184/242, 184/242/297/368, 184/290/297, 184/290/368, 184/293, 185, 186, 186/256, 186/256/270, 187, 187/220/350, 187/293, 188, 188/211, 188/211/242/290/297/368, 189, 189/200, 190, 190/193/197, 191, 192, 192/193, 192/193/211/242/297/368, 192/193/290/297/368, 193, 193/194, 193/197/296/303, 193/267, 193/290, 194, 194/242, 194/242/290, 195, 196, 197, 197/298, 198, 198/289, 199, 200, 200/202/203, 200/203, 200/203/226/230/339, 200/203/229/234, 200/203/290, 200/203/290/368, 200/206, 200/226, 200/226/321/373, 200/226/373, 200/230/257, 200/234/290, 200/235/368, 200/270, 200/270/275/339, 200/270/322/383, 200/271, 200/290/292/360, 200/344, 200/368, 201, 201/202, 201/202/272/360, 201/203, 201/203/226/234, 201/203/226/234/342/346, 201/203/226/234/346, 201/203/226/268/342, 201/203/226/346, 201/203/268/342, 201/203/268/346, 201/226/234/342/346, 201/226/234/346, 201/226/235/342, 201/226/268/346, 201/226/346, 201/230/257, 201/230/290, 201/235/268/342/346, 201/368, 201/371, 202, 202/233, 202/235/360/367/371, 203, 203/206/368, 203/226, 203/226/230, 203/226/230/257, 203/226/234/235, 203/226/234/235/346, 203/226/235/268/346, 203/226/235/342, 203/226/235/346, 203/226/342/346, 203/226/346, 203/229, 203/242/290/297/368, 203/297, 204, 204/264/340, 205, 206, 206/290, 206/297, 207, 207/210/273/279/344, 207/210/273/279/344/349/373, 207/210/273/321/344/349, 207/233/237/344/387, 207/235, 207/235/327/360/371, 207/235/368, 207/271/368/380, 207/273, 207/279/349, 207/368/373, 207/373, 207/380, 207/387, 209, 209/211, 210, 210/211, 210/211/242, 210/273/279, 210/273/279/349, 210/279, 210/339, 211, 211/368, 217, 219, 219/300, 219/358, 220, 220/224/315, 220/249, 220/293, 220/307/339, 220/315, 220/339, 220/349, 224, 224/296/298, 224/297/299, 224/298/299, 226, 226/234/235/346, 226/234/342, 226/235/268, 226/235/268/342/346, 226/235/268/346, 226/235/272/373, 226/235/342, 226/235/346, 226/268, 226/268/342, 226/268/342/346, 226/268/346, 226/272/373, 226/321/369, 226/342, 226/342/346, 226/346, 226/366, 226/366/369/387, 227, 228, 229, 229/325, 229/360, 230, 231, 232, 232/235, 232/235/273/368, 232/235/321, 232/346/350/355, 233, 233/271, 233/315, 233/367/371, 233/371, 234, 235, 235/268/327/346, 235/268/346, 235/271/272/339, 235/271/272/339/386, 235/271/339, 235/271/339/386, 235/272, 235/272/339, 235/272/386, 235/273, 235/280, 235/280/321/322/324, 235/280/321/324/383/386, 235/315, 235/315/353/355, 235/339, 235/339/386, 235/346, 235/346/350, 235/353, 235/353/355, 236, 237, 237/265, 237/266/360, 237/271, 237/360, 237/381, 238, 239, 241, 241/242/368, 242, 242/244, 242/290, 242/290/297, 242/331, 243, 244, 244/256/261/339/360, 245, 246, 247, 248, 249, 249/315/339, 250, 252, 253, 256, 256/259, 256/360, 257, 258, 259, 259/276/387, 260, 260/327, 260/331, 260/368, 261, 262, 262/325/349, 263, 264, 265, 265/346, 266, 266/297/299, 267, 267/270/275/339/347, 267/272/275, 268, 268/315/327/346, 268/315/346, 268/315/346/366, 268/315/355, 268/324, 268/324/327/346, 268/327/346, 268/346, 268/346/350/353/355, 268/346/355, 268/353, 268/355/366, 269, 270, 270/309, 270/322/344/383, 271, 271/339, 271/380, 272, 273, 273/279, 273/279/373, 274, 275, 275/291, 276, 277, 278, 279, 280, 280/383, 282, 284, 286, 287, 288, 289, 290, 290/303/364, 291, 292, 293, 293/350, 293/350/386, 294, 295, 296, 297, 298, 299, 300, 301, 302, 303, 304, 305, 306, 307, 308, 309, 310, 311, 313, 314, 315, 315/324/327/355/366, 315/327/346, 319, 321, 321/324, 322, 324, 324/327/346, 324/346/350, 324/346/355/366, 324/355, 325, 325/339, 326, 327, 327/346, 328, 330, 331, 332, 338, 339, 341, 342, 342/363, 344, 344/370, 345, 346, 347, 348, 349, 350, 351, 352, 353, 353/355, 355/373, 354, 355, 356, 358, 360, 360/383, 361, 362, 363, 364, 365, 366, 367, 367/371, 368, 369, 370, 371, 372, 373, 374, 376, 377, 378, 380, 381, 382, 383, 384, 385, 386, 387, 388, 390, and 391, and/or any combinations thereof, wherein the amino acid positions of the polypeptide sequence are numbered with reference to SEQ ID NOs: 5296, 5628, 5630, 5632, and/or 5636.

26. The engineered terminal deoxynucleotidyl transferase of claim 1, having at least one improved property, as compared to a wild-type terminal deoxynucleotidyl transferase or a reference engineered terminal deoxynucleotidyl transferase.

27. The engineered terminal deoxynucleotidyl transferase of claim 26, having at least one improved property, as compared to wild-type terminal deoxynucleotidyl transferase or a reference engineered terminal deoxynucleotidyl transferase, wherein said improved property is selected from increased thermostability, increased activity at elevated temperatures, increased soluble expression, decreased by-product formation, and increased conversion of substrates to products.

28. The engineered terminal deoxynucleotidyl transferase of claim 27, wherein said engineered terminal deoxynucleotidyl transferase comprises increased soluble expression as compared to a wild-type terminal deoxynucleotidyl transferase or a reference engineered terminal deoxynucleotidyl transferase.

29. The engineered terminal deoxynucleotidyl transferase of claim 27, wherein said engineered terminal deoxynucleotidyl transferase comprises increased activity at elevated temperatures as compared to a wild-type terminal deoxynucleotidyl transferase or a reference engineered terminal deoxynucleotidyl transferase.

30. The engineered terminal deoxynucleotidyl transferase of claim 27, wherein said engineered terminal deoxynucleotidyl transferase comprises decreased by-product formation as compared to a wild-type terminal deoxynucleotidyl transferase or a reference engineered terminal deoxynucleotidyl transferase.

31. The engineered terminal deoxynucleotidyl transferase of claim 27, wherein said engineered terminal deoxynucleotidyl transferase comprises increased conversion of substrates to products as compared to a wild-type terminal deoxynucleotidyl transferase or a reference engineered terminal deoxynucleotidyl transferase.

32. The engineered terminal deoxynucleotidyl transferase of claim 27, wherein said engineered terminal deoxynucleotidyl transferase comprises increased thermostability as compared to a wild-type terminal deoxynucleotidyl transferase or a reference engineered terminal deoxynucleotidyl transferase.

33. The engineered terminal deoxynucleotidyl transferase of claim 32, wherein the improved property is increased thermostability of 2-fold, 5-fold, 10-fold, 15-fold, or more, as compared to a reference terminal deoxynucleotidyl transferase.

34. The engineered terminal deoxynucleotidyl transferase of claim 27, wherein the improved property is increased activity of the engineered terminal deoxynucleotidyl transferase by 2-fold, 5-fold, 10-fold, 15-fold, or more at 40° C., 45° C., 50° C., 55° C., 60° C., 65° C., 70° C., or 75° C., as compared to a reference terminal deoxynucleotidyl transferase.

35. The engineered terminal deoxynucleotidyl transferase of claim 32, wherein the engineered terminal deoxynucleotidyl transferase comprises at least one residue difference at an amino acid position selected from 80, 87, 111, 143, 147, 157, 160, 180, 203, 209, 226, 256, 261, 266, 279, 327, 339, 349, 353, and 364.

36. The engineered terminal deoxynucleotidyl transferase of claim 35, wherein the engineered terminal deoxynucleotidyl transferase comprises at least one residue difference selected from 143A, 157V, 203D, 209E and 353N.

37. The engineered terminal deoxynucleotidyl transferase of claim 27, wherein the improved property is increased conversion of the substrate to product by the engineered TdT at a rate of 5%, 20%, 30%, 40%, 50%, 60%, 70%, 80%, 90%, 95% or more.

38. The engineered terminal deoxynucleotidyl transferase of claim 31, wherein the engineered terminal deoxynucleotidyl transferase comprises at least one residue difference at an amino acid position selected from 53, 65, 159, 211, 217, 224, 271, 272, 273, 275,278, 331, 341, and 391.

39. The engineered terminal deoxynucleotidyl transferase of claim 38, wherein the engineered terminal deoxynucleotidyl transferase comprises at least one residue difference selected from 53T, 159R, 211V, 217R, 271H, 272A, 275Q, 278G, 331K and 391L.

40. The engineered terminal deoxynucleotidyl transferase of claim 1, further comprising a residue difference(s) or a residue difference set(s) at amino acid positions selected from 53, 65, 80, 87, 111, 143, 147, 157,159, 160, 180, 203, 209, 211, 217, 224, 226, 256, 261, 266, 271, 272, 273, 275, 278, 279, 327, 331, 339, 341, 349, 364, and 391, and/or any combinations thereof, wherein the amino acid positions are numbered with reference to SEQ ID NO: 5296.

41. The engineered terminal deoxynucleotidyl transferase of claim 1, wherein said engineered terminal deoxynucleotidyl transferase is purified.

42. A composition comprising at least one engineered terminal deoxynucleotidyl transferase of claim 1.

* * * * *